United States Patent 9,782,462 (MODIFIED POLYNUCLEOTIDES FOR THE PRODUCTION OF PROTEINS ASSOCIATED WITH HUMAN DISEASE) - sequence listing, part 50

SEQ ID NO: 94534 - DNA, 567 bp, Artificial Sequence
  Description of Artificial Sequence: Synthetic coding sequence
atggccgccgccggcgccagacccgtggagctgggcttcgccgagagcgcccccgcctggagactgagaagcgagcagttccccagcaaggtgtacgcccccctgcccggcagacccgacgccttccacagatgcatcttcctgttctgctgcagagagcagccctgctgcgccggcctgagagtgttcagaaaccagctgcccagaaagaacgacttctacagctacgagccccccagcgagaaccccccccccgagaccggcgagagcgtgtgcctgcagctgaagagcggcgcccacctgtgcagagtgtgcggctgcctgggccccaagacctgcagcagatgccacaaggcctactactgcagcaaggagcaccagaccctggactggagactgggccacaagcaggcctgcgcccagcccgaccacctggaccacatcatccccgaccacaacttcctgttccccgagttcgagatcgtgatcgagaccgaggacgagatcatgcccgaggtggtggagaaggaggactacagcgagatcatcggcagcatgggcatctag

SEQ ID NO: 94535 - DNA, 2607 bp, Artificial Sequence
  Description of Artificial Sequence: Synthetic coding sequence
atggccaccttcatcagcgtgcagctgaagaagaccagcgaggtggacctggccaagcccctggtgaagttcatccagcagacctaccccagcggcggcgaggagcaggcccagtactgcagagccgccgaggagctgagcaagctgagaagagccgccgtgggcagacccctggacaagcacgagggcgccctggagaccctgctgagatactacgaccagatctgcagcatcgagcccaagttccccttcagcgagaaccagatctgcctgaccttcacctggaaggacgccttcgacaagggcagcctgttcggcggcagcgtgaagctggccctggccagcctgggctacgagaagagctgcgtgctgttcaactgcgccgccctggccagccagatcgccgccgagcagaacctggacaacgacgagggcctgaagatcgccgccaagcactaccagttcgccagcggcgccttcctgcacatcaaggagaccgtgctgagcgccctgagcagagagcccaccgtggacatcagccccgacaccgtgggcaccctgagcctgatcatgctggcccaggcccaggaggtgttcttcctgaaggccaccagagacaagatgaaggacgccatcatcgccaagctggccaaccaggccgccgactacttcggcgacgccttcaagcagtgccagtacaaggacaccctgcccaaggaggtgttccccgtgctggccgccaagcactgcatcatgcaggccaacgccgagtaccaccagagcatcctggccaagcagcagaagaagttcggcgaggagatcgccagactgcagcacgccgccgagctgatcaagaccgtggccagcagatacgacgagtacgtgaacgtgaaggacttcagcgacaagatcaacagagccctggccgccgccaagaaggacaacgacttcatctaccacgacagagtgcccgacctgaaggacctggaccccatcggcaaggccaccctggtgaagagcacccccgtgaacgtgcccatcagccagaagttcaccgacctgttcgagaagatggtgcccgtgagcgtgcagcagagcctggccgcctacaaccagagaaaggccgacctggtgaacagaagcatcgcccagatgagagaggccaccaccctggccaacggcgtgctggccagcctgaacctgcccgccgccatcgaggacgtgagcggcgacaccgtgccccagagcatcctgaccaagagcagaagcgtgatcgagcagggcggcatccagaccgtggaccagctgatcaaggagctgcccgagctgctgcagagaaacagagagatcctggacgagagcctgagactgctggacgaggaggaggccaccgacaacgacctgagagccaagttcaaggagagatggcagagaacccccagcaacgagctgtacaagcccctgagagccgagggcaccaacttcagaaccgtgctggacaaggccgtgcaggccgacggccaggtgaaggagtgctaccagagccacagagacaccatcgtgctgctgtgcaagcccgagcccgagctgaacgccgccatccccagcgccaaccccgccaagaccatgcagggcagcgaggtggtgaacgtgctgaagagcctgctgagcaacctggacgaggtgaagaaggagagagagggcctggagaacgacctgaagagcgtgaacttcgacatgaccagcaagttcctgaccgccctggcccaggacggcgtgatcaacgaggaggccctgagcgtgaccgagctggacagagtgtacggcggcctgaccaccaaggtgcaggagagcctgaagaagcaggagggcctgctgaagaacatccaggtgagccaccaggagttcagcaagatgaagcagagcaacaacgaggccaacctgagagaggaggtgctgaagaacctggccaccgcctacgacaacttcgtggagctggtggccaacctgaaggagggcaccaagttctacaacgagctgaccgagatcctggtgagattccagaacaagtgcagcgacatcgtgttcgccagaaagaccgagagagacgagctgctgaaggacctgcagcagagcatcgccagagagcccagcgcccccagcatccccacccccgcctaccagagcagccccgccggcggccacgcccccaccccccccacccccgcccccagaaccatgccccccaccaagccccagccccccgccagaccccccccccccgtgctgcccgccaacagagcccccagcgccaccgcccccagccccgtgggcgccggcaccgccgcccccgcccccagccagacccccggcagcgccccccccccccaggcccagggccccccctaccccacctaccccggctaccccggctactgccagatgcccatgcccatgggctacaacccctacgcctacggccagtacaacatgccctacccccccgtgtaccaccagagccccggccaggccccctaccccggcccccagcagcccagctaccccttcccccagcccccccagcagagctactacccccagcagtag

SEQ ID NO: 94536 - DNA, 2622 bp, Artificial Sequence
  Description of Artificial Sequence: Synthetic coding sequence
atggccaccttcatcagcgtgcagctgaagaagaccagcgaggtggacctggccaagcccctggtgaagttcatccagcagacctaccccagcggcggcgaggagcaggcccagtactgcagagccgccgaggagctgagcaagctgagaagagccgccgtgggcagacccctggacaagcacgagggcgccctggagaccctgctgagatactacgaccagatctgcagcatcgagcccaagttccccttcagcgagaaccagatctgcctgaccttcacctggaaggacgccttcgacaagggcagcctgttcggcggcagcgtgaagctggccctggccagcctgggctacgagaagagctgcgtgctgttcaactgcgccgccctggccagccagatcgccgccgagcagaacctggacaacgacgagggcctgaagatcgccgccaagcactaccagttcgccagcggcgccttcctgcacatcaaggagaccgtgctgagcgccctgagcagagagcccaccgtggacatcagccccgacaccgtgggcaccctgagcctgatcatgctggcccaggcccaggaggtgttcttcctgaaggccaccagagacaagatgaaggacgccatcatcgccaagctggccaaccaggccgccgactacttcggcgacgccttcaagcagtgccagtacaaggacaccctgcccaagtacttctacttccaggaggtgttccccgtgctggccgccaagcactgcatcatgcaggccaacgccgagtaccaccagagcatcctggccaagcagcagaagaagttcggcgaggagatcgccagactgcagcacgccgccgagctgatcaagaccgtggccagcagatacgacgagtacgtgaacgtgaaggacttcagcgacaagatcaacagagccctggccgccgccaagaaggacaacgacttcatctaccacgacagagtgcccgacctgaaggacctggaccccatcggcaaggccaccctggtgaagagcacccccgtgaacgtgcccatcagccagaagttcaccgacctgttcgagaagatggtgcccgtgagcgtgcagcagagcctggccgcctacaaccagagaaaggccgacctggtgaacagaagcatcgcccagatgagagaggccaccaccctggccaacggcgtgctggccagcctgaacctgcccgccgccatcgaggacgtgagcggcgacaccgtgccccagagcatcctgaccaagagcagaagcgtgatcgagcagggcggcatccagaccgtggaccagctgatcaaggagctgcccgagctgctgcagagaaacagagagatcctggacgagagcctgagactgctggacgaggaggaggccaccgacaacgacctgagagccaagttcaaggagagatggcagagaacccccagcaacgagctgtacaagcccctgagagccgagggcaccaacttcagaaccgtgctggacaaggccgtgcaggccgacggccaggtgaaggagtgctaccagagccacagagacaccatcgtgctgctgtgcaagcccgagcccgagctgaacgccgccatccccagcgccaaccccgccaagaccatgcagggcagcgaggtggtgaacgtgctgaagagcctgctgagcaacctggacgaggtgaagaaggagagagagggcctggagaacgacctgaagagcgtgaacttcgacatgaccagcaagttcctgaccgccctggcccaggacggcgtgatcaacgaggaggccctgagcgtgaccgagctggacagagtgtacggcggcctgaccaccaaggtgcaggagagcctgaagaagcaggagggcctgctgaagaacatccaggtgagccaccaggagttcagcaagatgaagcagagcaacaacgaggccaacctgagagaggaggtgctgaagaacctggccaccgcctacgacaacttcgtggagctggtggccaacctgaaggagggcaccaagttctacaacgagctgaccgagatcctggtgagattccagaacaagtgcagcgacatcgtgttcgccagaaagaccgagagagacgagctgctgaaggacctgcagcagagcatcgccagagagcccagcgcccccagcatccccacccccgcctaccagagcagccccgccggcggccacgcccccaccccccccacccccgcccccagaaccatgccccccaccaagccccagccccccgccagaccccccccccccgtgctgcccgccaacagagcccccagcgccaccgcccccagccccgtgggcgccggcaccgccgcccccgcccccagccagacccccggcagcgccccccccccccaggcccagggccccccctaccccacctaccccggctaccccggctactgccagatgcccatgcccatgggctacaacccctacgcctacggccagtacaacatgccctacccccccgtgtaccaccagagccccggccaggccccctaccccggcccccagcagcccagctaccccttcccccagcccccccagcagagctactacccccagcagtag

SEQ ID NO: 94537 - DNA, 1458 bp, Artificial Sequence
  Description of Artificial Sequence: Synthetic coding sequence
atggccctgccccccttcttcggccagggcagacccggccccccccccccccagccccccccccccgcccccttcggctgcccccccccccccctgcccagccccgccttccccccccccctgccccagagacccggccccttccccggcgccagcgcccccttcctgcagccccccctggccctgcagcccagagccagcgccgaggccagcagaggcggcggcggcgccggcgccttctaccccgtgccccccccccccctgccccccccccccccccagtgcagacccttccccggcaccgacgccggcgagagacccagaccccccccccccggccccggccccccctggagccccagatggcccgaggccccccccccccccgccgacgtgctgggcgacgccgccctgcagagactgagagacagacagtggctggaggccgtgttcggcacccccagaagagccggctgccccgtgccccagagaacccacgccggccccagcctgggcgaggtgagagccagactgctgagagccctgagactggtgagaagactgagaggcctgagccaggccctgagagaggccgaggccgacggcgccgcctgggtgctgctgtacagccagaccgcccccctgagagccgagctggccgagagactgcagcccctgacccaggccgcctacgtgggcgaggccagaagaagactggagagagtgagaagaagaagactgagactgagagagagagccagagagagagaggccgagagagaggccgaggccgccagagccgtggagagagagcaggagatcgacagatggagagtgaagtgcgtgcaggaggtggaggagaagaagagagagcaggagctgaaggccgccgccgacggcgtgctgagcgaggtgagaaagaagcaggccgacaccaagagaatggtggacatcctgagagccctggagaagctgagaaagctgagaaaggaggccgccgccagaaagggcgtgtgcccccccgccagcgccgacgagaccttcacccaccacctgcagagactgagaaagctgatcaagaagagaagcgagctgtacgaggccgaggagagagccctgagagtgatgctggagggcgagcaggaggaggagagaaagagagagctggagaagaagcagagaaaggagaaggagaagatcctgctgcagaagagagagatcgagagcaagctgttcggcgaccccgacgagttccccctggcccacctgctggagcccttcagacagtactacctgcaggccgagcacagcctgcccgccctgatccagatcagacacgactgggaccagtacctggtgcccagcgaccaccccaagggcaacttcgtgccccagggctgggtgctgccccccctgcccagcaacgacatctgggccaccgccgtgaagctgcactag

SEQ ID NO: 94538 - DNA, 840 bp, Artificial Sequence
  Description of Artificial Sequence: Synthetic coding sequence
ctgatgagaagccacagcgacagctgccacttcagcaagcacctgagaagagagcacggccccgccaccatcctgagacccggcagccccagacccccccccccccccagcttcagcctgagaagactgagagagagagccagagagagagaggccgagagagaggccgaggccgccagagccgtggagagagagcaggagatcgacagatggagagtgaagtgcgtgcaggaggtggaggagaagaagagagagcaggagctgaaggccgccgccgacggcgtgctgagcgaggtgagaaagaagcaggccgacaccaagagaatggtggacatcctgagagccctggagaagctgagaaagctgagaaaggaggccgccgccagaaagggcgtgtgcccccccgccagcgccgacgagaccttcacccaccacctgcagagactgagaaagctgatcaagaagagaagcgagctgtacgaggccgaggagagagccctgagagtgatgctggagggcgagcaggaggaggagagaaagagagagctggagaagaagcagagaaaggagaaggagaagatcctgctgcagaagagagagatcgagagcaagctgttcggcgaccccgacgagttccccctggcccacctgctggagcccttcagacagtactacctgcaggccgagcacagcctgcccgccctgatccagatcagacacgactgggaccagtacctggtgcccagcgaccaccccaagggcaacttcgtgccccagggctgggtgctgccccccctgcccagcaacgacatctgggccaccgccgtgaagctgcactag

SEQ ID NO: 94539 - DNA, 813 bp, Artificial Sequence
  Description of Artificial Sequence: Synthetic coding sequence
agccacagcgacagctgccacttcagcaagcacctgagaagagagcacggccccgccaccatcctgagacccggcagccccagaagaagaagactgagactgagagagagagccagagagagagaggccgagagagaggccgaggccgccagagccgtggagagagagcaggagatcgacagatggagagtgaagtgcgtgcaggaggtggaggagaagaagagagagcaggagctgaaggccgccgccgacggcgtgctgagcgaggtgagaaagaagcaggccgacaccaagagaatggtggacatcctgagagccctggagaagctgagaaagctgagaaaggaggccgccgccagaaagggcgtgtgcccccccgccagcgccgacgagaccttcacccaccacctgcagagactgagaaagctgatcaagaagagaagcgagctgtacgaggccgaggagagagccctgagagtgatgctggagggcgagcaggaggaggagagaaagagagagctggagaagaagcagagaaaggagaaggagaagatcctgctgcagaagagagagatcgagagcaagctgttcggcgaccccgacgagttccccctggcccacctgctggagcccttcagacagtactacctgcaggccgagcacagcctgcccgccctgatccagatcagacacgactgggaccagtacctggtgcccagcgaccaccccaagggcaacttcgtgccccagggctgggtgctgccccccctgcccagcaacgacatctgggccaccgccgtgaagctgcactag

SEQ ID NO: 94540 - DNA, 165 bp, Artificial Sequence
  Description of Artificial Sequence: Synthetic coding sequence
atgtgcaccaccctgttcctgctgagcaccctggccatgctgtggagaagaagattcgccaacagagtgcagcccgagcccagcgacgtggacggcgccgccagaggcagcagcctggacgccgacccccagagcagcggcagagagaaggagcccctgaagtag

SEQ ID NO: 94541 - DNA, 246 bp, Artificial Sequence
  Description of Artificial Sequence: Synthetic coding sequence
atgaccagaaccgagagccccgccacctggatgggccagctgggcgccgccgcctggatgagaaccctgagcccccaggccgcccaggtgctggtgagacccctggcccaggaggacgccgtgggcgccgccgccgccgccagaggcagaatgggcggcagcagcaccagagaggtgcccagagcccaccccgtgaccggctgcagcgccgagatcatcaacaagaagtgccagctggacctgtag

SEQ ID NO: 94542 - DNA, 819 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacccagagagagctggtgagcagacaggtgagcgacgacctgaccgagagagccgccaccttcggcctgatcctggacgacgtgagcctgacccacctgaccttcggcaaggagttcaccgaggccgtggaggccaagcaggtggcccagcaggaggccgagagagccagattcgtggtggagaaggccgagcagcagaagaaggccgccatcatcagcgccgagggcgacagcaaggccgccgagctgatcgccaacagcctggccaccgccggcgacggcctgatcgagctgagaaagctggaggccgccgaggacatcgcctaccagctgagcagaagcagaaacatcacctacctgcccgccggccagagcgtgctgctgcagctgccccagtag

SEQ ID NO: 94543 - DNA, 741 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacccagagagagctggtgagcagacaggtgagcgacgacctgaccgagagagccgccaccttcggcctgatcctggacgacgtgagcctgacccacctgaccttcggcaaggagttcaccgaggccgtggaggccaagcaggtggcccagcaggaggccgagagagccagattcgtggtggagaaggccgagcagcagaagaaggccgccatcatcagcgccgagggcgacagcaaggccgccgagctgatcgccaacagcctggccaccgccggcgacggcctgatcgagctgagaaagctggaggccgccgaggactag

SEQ ID NO: 94544 - DNA, 375 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccacctag

SEQ ID NO: 94545 - DNA, 606 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacccagagagagctggtgagcagacaggtgagcgacgacctgaccgagagagccgccaccttcggcctgatcctggacgacgtgagcctgacccacctgaccttcggcaaggagttcaccgaggccgtggaggccaagcaggtggcccagcaggaggccgagagagccagattcgtggtggagtag

SEQ ID NO: 94546 - DNA, 645 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacccagagagagctggtgagcagacaggtgagcgacgacctgaccgagagagccgccaccttcggcctgatcctggacgacgtgagcctgacccacctgaccttcggcaaggagttcaccgaggccgtggaggccaagcaggtggcccagcaggaggccgagagagccagattcgtggtggagaaggccgagcagcagaagaaggccgccatcatcagcgcctag

SEQ ID NO: 94547 - DNA, 468 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacctacctgcccgccggccagagcgtgctgctgcagctgccccagtag

SEQ ID NO: 94548 - DNA, 615 bp, Artificial Sequence
  Description of Artificial Sequence: Synthetic coding sequence
atggccgccaaggtgttcgagagcatcggcaagttcggcctggccctggccgtggccggcggcgtggtgaacagcgccctgtacaacgtggacgccggccacagagccgtgatcttcgacagattcagaggcgtgcaggacatcgtggtgggcgagggcacccacttcctgatcccctgggtgcagaagcccatcatcttcgactgcagaagcagacccagaaacgtgcccgtgatcaccggcagcaaggacctgcagaacgtgaacatcaccctgagaatcctgttcagacccgtggccagccagctgcccagaatcttcaccagcatcggcgaggactacgacgagagagtgctgcccagcatcaccaccgagatcctgaagagcgtggtggccagattcgacgccggcgagctgatcacccagagagagctggtgagcagacaggtgagcgacgacctgaccgagagagccgccaccttcggcctgatcctggacgacgtgagcctgacccacctgaccttcggcaaggagttcaccgaggccgtggaggccaagcaggtggcccagcaggaggccgagagagccagattcgtggtggagaaggtgagctag

SEQ ID NO: 94549 - DNA, 900 bp, Artificial Sequence
  Description of Artificial Sequence: Synthetic coding sequence
atggcccagaacctgaaggacctggccggcagactgcccgccggccccagaggcatgggcaccgccctgaagctgctgctgggcgccggcgccgtggcctacggcgtgagagagagcgtgttcaccgtggagggcggccacagagccatcttcttcaacagaatcggcggcgtgcagcaggacaccatcctggccgagggcctgcacttcagaatcccctggttccagtaccccatcatctacgacatcagagccagacccagaaagatcagcagccccaccggcagcaaggacctgcagatggtgaacatcagcctgagagtgctgagcagacccaacgcccaggagctgcccagcatgtaccagagactgggcctggactacgaggagagagtgctgcccagcatcgtgaacgaggtgctgaagagcgtggtggccaagttcaacgccagccagctgatcacccagagagcccaggtgagcctgctgatcagaagagagctgaccgagagagccaaggacttcagcctgatcctggacgacgtggccatcaccgagctgagcttcagcagagagtacaccgccgccgtggaggccaagcaggtggcccagcaggaggcccagagagcccagttcctggtggagaaggccaagcaggagcagagacagaagatcgtgcaggccgagggcgaggccgaggccgccaagatgctgggcgaggccctgagcaagaaccccggctacatcaagctgagaaagatcagagccgcccagaacatcagcaagaccatcgccaccagccagaacagaatctacctgaccgccgacaacctggtgctgaacctgcaggacgagagcttcaccagatacagcgacagcctgatcaagggcaagaagtag

SEQ ID NO: 94550 - DNA, 786 bp, Artificial Sequence
  Description of Artificial Sequence: Synthetic coding sequence
atggcccagaacctgaaggacctggccggcagactgcccgccggccccagaggcatgggcaccgccctgaagctgctgctgggcgccggcgccgtggcctacggcgtgagagagagcgtgttcaccgtggagggcggccacagagccatcttcttcaacagaatcggcggcgtgcagcaggacaccatcctggccgagggcctgcacttcagaatcccctggttccagtaccccatcatctacgacatcagagccagacccagaaagatcagcagccccaccggcagcaaggacctgcagatggtgaacatcagcctgagagtgctgagcagacccaacgcccaggagctgcccagcatgtaccagagactgggcctggactacgaggagagagtgctgcccagcatcgtgaacgaggtgctgaagagcgtggtggccaagttcaacgccagccagctgatcacccagagagcccaggtgagcctgctgatcagaagagagctgaccgagagagccaaggacttcagcctgatcctggacgacgtggccatcaccgagctgagcttcagcagagagtacaccgccgccgtggaggccaagcaggtggccctgagcaagaaccccggctacatcaagctgagaaagatcagagccgcccagaacatcagcaagaccatcgccaccagccagaacagaatctacctgaccgccgacaacctggtgctgaacctgcaggacgagagcttcaccagaggcagcgacagcctgatcaagggcaagaagtag

SEQ ID NO: 94551 - DNA, 900 bp, Artificial Sequence
  Description of Artificial Sequence: Synthetic coding sequence
atggcccagaacctgaaggacctggccggcagactgcccgccggccccagaggcatgggcaccgccctgaagctgctgctgggcgccggcgccgtggcctacggcgtgagagagagcgtgttcaccgtggagggcggccacagagccatcttcttcaacagaatcggcggcgtgcagcaggacaccatcctggccgagggcctgcacttcagaatcccctggttccagtaccccatcatctacgacatcagagccagacccagaaagatcagcagccccaccggcagcaaggacctgcagatggtgaacatcagcctgagagtgctgagcagacccaacgcccaggagctgcccagcatgtaccagagactgggcctggactacgaggagagagtgctgcccagcatcgtgaacgaggtgctgaagagcgtggtggccaagttcaacgccagccagctgatcacccagagagcccaggtgagcctgctgatcagaagagagctgaccgagagagccaaggacttcagcctgatcctggacgacgtggccatcaccgagctgagcttcagcagagagtacaccgccgccgtggaggccaagcaggtggcccagcaggaggcccagagagcccagttcctggtggagaaggccaagcaggagcagagacagaagatcgtgcaggccgagggcgaggccgaggccgccaagatgctgggcgaggccctgagcaagaaccccggctacatcaagctgagaaagatcagagccgcccagaacatcagcaagaccatcgccaccagccagaacagaatctacctgaccgccgacaacctggtgctgaacctgcaggacgagagcttcaccagaggcagcgacagcctgatcaagggcaagaagtag

SEQ ID NO: 94552 - DNA, 642 bp, Artificial Sequence
  Description of Artificial Sequence: Synthetic coding sequence
atggcccagaacctgaaggacctggccggcagactgcccgccggccccagaggcatgggcaccgccctgaagctgctgctgggcgccggcgccgtggcctacggcgtgagagagagcgtgttcaccgtggagggcggccacagagccatcttcttcaacagaatcggcggcgtgcagcaggacaccatcctggccgagggcctgcacttcagaatcccctggttccagtaccccatcatctacgacatcagagccagacccagaaagatcagcagccccaccggcagcaaggacctgcagatggtgaacatcagcctgagagtgctgagcagacccaacgcccaggagctgcccagcatgtaccagagactgggcctggactacgaggagagagtgctgcccagcatcgtgaacgaggtgctgaagagcgtggtggccaagttcaacgccagccagctgatcacccagagagcccaggtgagcctgctgatcagaagagagctgaccgagagagccaaggacttcagcctgatcctggacgacgtggccatcaccgagctgagcttcagcagagagtacaccgccgccgtggaggccaagcaggtgggcgagagccaggagccctggggcgagggcttctag

SEQ ID NO: 94553 - DNA, 318 bp, Artificial Sequence
  Description of Artificial Sequence: Synthetic coding sequence
atgagaggcgccaccagagtgagcatcatgctgctgctggtgaccgtgagcgactgcgccgtgatcaccggcgcctgcgagagagacgtgcagtgcggcgccggcacctgctgcgccatcagcctgtggctgagaggcctgagaatgtgcacccccctgggcagagagggcgaggagtgccaccccggcagccacaaggtgcccttcttcagaaagagaaagcaccacacctgcccctgcctgcccaacctgctgtgcagcagattccccgacggcagatacagatgcagcatggacctgaagaacatcaacttctag

SEQ ID NO: 94554 - DNA, 390 bp, Artificial Sequence
  Description of Artificial Sequence: Synthetic coding sequence
atgagaagcctgtgctgcgcccccctgctgctgctgctgctgctgccccccctgctgctgacccccagagccggcgacgccgccgtgatcaccggcgcctgcgacaaggacagccagtgcggcggcggcatgtgctgcgccgtgagcatctgggtgaagagcatcagaatctgcacccccatgggcaagctgggcgacagctgccaccccctgaccagaaagaacaacttcggcaacggcagacaggagagaagaaagagaaagagaagcaagagaaagaaggaggtgcccttcttcggcagaagaatgcaccacacctgcccctgcctgcccggcctggcctgcctgagaaccagcttcaacagattcatctgcctggcccagaagtag

SEQ ID NO: 94555 - DNA, 327 bp, Artificial Sequence
  Description of Artificial Sequence: Synthetic coding sequence
atgagaagcctgtgctgcgcccccctgctgctgctgctgctgctgccccccctgctgctgacccccagagccggcgacgccgccgtgatcaccggcgcctgcgacaaggacagccagtgcggcggcggcatgtgctgcgccgtgagcatctgggtgaagagcatcagaatctgcacccccatgggcaagctgggcgacagctgccaccccctgaccagaaaggtgcccttcttcggcagaagaatgcaccacacctgcccctgcctgcccggcctggcctgcctgagaaccagcttcaacagattcatctgcctggcccagaagtag

SEQ ID NO: 94556 - DNA, 705 bp, Artificial Sequence
  Description of Artificial Sequence: Synthetic coding sequence
atgagagcccccctgtgcctgctgctgctggtggcccacgccgtggacatgctggccctgaacagaagaaagaagcaggtgggcaccggcctgggcggcaactgcaccggctgcatcatctgcagcgaggagaacggctgcagcacctgccagcagagactgttcctgttcatcagaagagagggcatcagacagtacggcaagtgcctgcacgactgcccccccggctacttcggcatcagaggccaggaggtgaacagatgcaagaagtgcggcgccacctgcgagagctgcttcagccaggacttctgcatcagatgcaagagacagttctacctgtacaagggcaagtgcctgcccacctgcccccccggcaccctggcccaccagaacaccagagagtgccagggcgagtgcgagctgggcccctggggcggctggagcccctgcacccacaacggcaagacctgcggcagcgcctggggcctggagagcagagtgagagaggccggcagagccggccacgaggaggccgccacctgccaggtgctgagcgagagcagaaagtgccccatccagagaccctgccccggcgagagaagccccggccagaagaagggcagaaaggacagaagacccagaaaggacagaaagctggacagaagactggacgtgagacccagacagcccggcctgcagccctag

SEQ ID NO: 94557 - DNA, 1155 bp, Artificial Sequence
  Description of Artificial Sequence: Synthetic coding sequence
atggccgcccagaacggcaacaccagcttcacccccaacttcaaccccccccaggaccacgccagcagcctgagcttcaacttcagctacggcgactacgacctgcccatggacgaggacgaggacatgaccaagaccagaaccttcttcgccgccaagatcgtgatcggcatcgccctggccggcatcatgctggtgtgcggcatcggcaacttcgtgttcatcgccgccctgaccagatacaagaagctgagaaacctgaccaacctgctgatcgccaacctggccatcagcgacttcctggtggccatcatctgctgccccttcgagatggactactacgtggtgagacagctgagctgggagcacggccacgtgctgtgcgccagcgtgaactacctgagaaccgtgagcctgtacgtgagcaccaacgccctgctggccatcgccatcgacagatacctggccatcgtgcaccccctgaagcccagaatgaactaccagaccgccagcttcctgatcgccctggtgtggatggtgagcatcctgatcgccatccccagcgcctacttcgccaccgagaccgtgctgttcatcgtgaagagccaggagaagatcttctgcggccagatctggcccgtggaccagcagctgtactacaagagctacttcctgttcatcttcggcgtggagttcgtgggccccgtggtgaccatgaccctgtgctacgccagaatcagcagagagctgtggttcaaggccgtgcccggcttccagaccgagcagatcagaaagagactgagatgcagaagaaagaccgtgctggtgctgatgtgcatcctgaccgcctacgtgctgtgctgggcccccttctacggcttcaccatcgtgagagacttcttccccaccgtgttcgtgaaggagaagcactacctgaccgccttctacgtggtggagtgcatcgccatgagcaacagcatgatcaacaccgtgtgcttcgtgaccgtgaagaacaacaccatgaagtacttcaagaagatgatgctgctgcactggagacccagccagagaggcagcaagagcagcgccgacctggacctgagaaccaacggcgtgcccaccaccgaggaggtggactgcatcagactgaagtag

SEQ ID NO: 94558 - DNA, 684 bp, Artificial Sequence
  Description of Artificial Sequence: Synthetic coding sequence
atgaacatcaagggcagcccctggaagggcagcctgctgctgctgctggtgagcaacctgctgctgtgccagagcgtggcccccctgcccatctgccccggcggcgccgccagatgccaggtgaccctgagagacctgttcgacagagccgtggtgctgagccactacatccacaacctgagcagcgagatgttcagcgagttcgacaagagatacacccacggcagaggcttcatcaccaaggccatcaacagctgccacaccagcagcctggccacccccgaggacaaggagcaggcccagcagatgaaccagaaggacttcctgagcctgatcgtgagcatcctgagaagctggaacgagcccctgtaccacctggtgaccgaggtgagaggcatgcaggaggcccccgaggccatcctgagcaaggccgtggagatcgaggagcagaccaagagactgctggagggcatggagctgatcgtgagccaggtgcaccccgagaccaaggagaacgagatctaccccgtgtggagcggcctgcccagcctgcagatggccgacgaggagagcagactgagcgcctactacaacctgctgcactgcctgagaagagacagccacaagatcgacaactacctgaagctgctgaagtgcagaatcatccacaacaacaactgctag

SEQ ID NO: 94559 - DNA, 591 bp, Artificial Sequence
  Description of Artificial Sequence: Synthetic coding sequence
atgaacatcaagggcagcccctggaagggcagcctgctgctgctgctggtgagcaacctgctgctgagccactacatccacaacctgagcagcgagatgttcagcgagttcgacaagagatacacccacggcagaggcttcatcaccaaggccatcaacagctgccacaccagcagcctggccacccccgaggacaaggagcaggcccagcagatgaaccagaaggacttcctgagcctgatcgtgagcatcctgagaagctggaacgagcccctgtaccacctggtgaccgaggtgagaggcatgcaggaggcccccgaggccatcctgagcaaggccgtggagatcgaggagcagaccaagagactgctggagggcatggagctgatcgtgagccaggtgcaccccgagaccaaggagaacgagatctaccccgtgtggagcggcctgcccagcctgcagatggccgacgaggagagcagactgagcgcctactacaacctgctgcactgcctgagaagagacagccacaagatcgacaactacctgaagctgctgaagtgcagaatcatccacaacaacaactgctag

SEQ ID NO: 94560 - DNA, 1545 bp, Artificial Sequence
  Description of Artificial Sequence: Synthetic coding sequence
atgaccctgatctggagacacctgctgagacccctgtgcctggtgaccagcgcccccagaatcctggagatgcaccccttcctgagcctgggcaccagcagaaccagcgtgaccaagctgagcctgcacaccaagcccagaatgcccccctgcgacttcatgcccgagagataccagagcctgggctacaacagagtgctggagatccacaaggagcacctgagccccgtggtgaccgcctacttccagaagcccctgctgctgcaccagggccacatggagtggctgttcgacgccgagggcagcagatacctggacttcttcagcggcatcgtgaccgtgagcgtgggccactgccaccccaaggtgaacgccgtggcccagaagcagctgggcagactgtggcacaccagcaccgtgttcttccacccccccatgcacgagtacgccgagaagctggccgccctgctgcccgagcccctgaaggtgatcttcctggtgaacagcggcagcgaggccaacgagctggccatgctgatggccagagcccacagcaacaacatcgacatcatcagcttcagaggcgcctaccacggctgcagcccctacaccctgggcctgaccaacgtgggcacctacaagatggagctgcccggcggcaccggctgccagcccaccatgtgccccgacgtgttcagaggcccctggggcggcagccactgcagagacagccccgtgcagaccatcagaaagtgcagctgcgcccccgactgctgccaggccaaggaccagtacatcgagcagttcaaggacaccctgagcaccagcgtggccaagagcatcgccggcttcttcgccgagcccatccagggcgtgaacggcgtggtgcagtaccccaagggcttcctgaaggaggccttcgagctggtgagagccagaggcggcgtgtgcatcgccgacgaggtgcagaccggcttcggcagactgggcagccacttctggggcttccagacccacgacgtgctgcccgacatcgtgaccatggccaagggcatcggcaacggcttccccatggccgccgtgatcaccacccccgagatcgccaagagcctggccaagtgcctgcagcacttcaacaccttcggcggcaaccccatggcctgcgccatcggcagcgccgtgctggaggtgatcaaggaggagaacctgcaggagaacagccaggaggtgggcacctacatgctgctgaagttcgccaagctgagagacgagttcgagatcgtgggcgacgtgagaggcaagggcctgatgatcggcatcgagatggtgcaggacaagatcagctgcagacccctgcccagagaggaggtgaaccagatccacgaggactgcaagcacatgggcctgctggtgggcagaggcagcatcttcagccagaccttcagaatcgcccccagcatgtgcatcaccaagcccgaggtggacttcgccgtggaggtgttcagaagcgccctgacccagcacatggagagaagagccaagtag

SEQ ID NO: 94561 - DNA, 1050 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggagaagggcaagagcgaggagctgctgagcgccctgggctgccaggacttcccccccaccagcgactacgaggacctgctggtggagtacctggaggtggacgacagcgaggaccagcacctgatgagcgtgcacagcaaggagcaccccagccaggagagagagcagagacaggcccaggaggccagagacagctag

SEQ ID NO: 94562 - DNA, 1566 bp, Artificial Sequence
  Description of Artificial Sequence: Synthetic coding sequence
atgaaggagaacgtggccagcgccaccgtgttcaccctgctgctgttcctgaacacctgcctgctgaacgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggagaagggcaagagcgaggagctgctgagcgccctgggctgccaggacttcccccccaccagcgactacgaggacctgctggtggagtacctggaggtggacgacagcgaggaccagcacctgatgagcgtgcacagcaaggagcaccccagccagggcatgaagcccacctacctggaccccgacaccgacagcggcagaggcagctgcgacagccccagcctgctgagcgagaagtgcgaggagccccaggccaaccccagcaccttctacgaccccgaggtgatcgagaagcccgagaaccccgagaccacccacacctgggacccccagtgcatcagcatggagggcaagatcccctacttccacgccggcggcagcaagtgcagcacctggcccctgccccagcccagccagcacaaccccagaagcagctaccacaacatcaccgacgtgtgcgagctggccgtgggccccgccggcgcccccgccaccctgctgaacgaggccggcaaggacgccctgaagagcagccagaccatcaagagcagagaggagggcaaggccacccagcagagagaggtggagagcttccacagcgagaccgaccaggacaccccctggctgctgccccaggagaagacccccttcggcagcgccaagcccctggactacgtggagatccacaaggtgaacaaggacggcgccctgagcctgctgcccaagcagagagagaacagcggcaagcccaagaagcccggcacccccgagaacaacaaggagtacgccaaggtgagcggcgtgatggacaacaacatcctggtgctggtgcccgacccccacgccaagaacgtggcctgcttcgaggagagcgccaaggaggccccccccagcctggagcagaaccaggccgagaaggccctggccaacttcaccgccaccagcagcaagtgcagactgcagctgggcggcctggactacctggaccccgcctgcttcacccacagcttccactag

SEQ ID NO: 94563 - DNA, 807 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcggcgaccccctgatgctgggcgccagccactacaagaacctgaagagctacagacccagaaagatcagcagccagggcagactggccgtgttcaccaaggccaccctgaccaccgtgcagtag

SEQ ID NO: 94564 - DNA, 1869 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggagaagggcaagagcgaggagctgctgagcgccctgggctgccaggacttcccccccaccagcgactacgaggacctgctggtggagtacctggaggtggacgacagcgaggaccagcacctgatgagcgtgcacagcaaggagcaccccagccagggcatgaagcccacctacctggaccccgacaccgacagcggcagaggcagctgcgacagccccagcctgctgagcgagaagtgcgaggagccccaggccaaccccagcaccttctacgaccccgaggtgatcgagaagcccgagaaccccgagaccacccacacctgggacccccagtgcatcagcatggagggcaagatcccctacttccacgccggcggcagcaagtgcagcacctggcccctgccccagcccagccagcacaaccccagaagcagctaccacaacatcaccgacgtgtgcgagctggccgtgggccccgccggcgcccccgccaccctgctgaacgaggccggcaaggacgccctgaagagcagccagaccatcaagagcagagaggagggcaaggccacccagcagagagaggtggagagcttccacagcgagaccgaccaggacaccccctggctgctgccccaggagaagacccccttcggcagcgccaagcccctggactacgtggagatccacaaggtgaacaaggacggcgccctgagcctgctgcccaagcagagagagaacagcggcaagcccaagaagcccggcacccccgagaacaacaaggagtacgccaaggtgagcggcgtgatggacaacaacatcctggtgctggtgcccgacccccacgccaagaacgtggcctgcttcgaggagagcgccaaggaggccccccccagcctggagcagaaccaggccgagaaggccctggccaacttcaccgccaccagcagcaagtgcagactgcagctgggcggcctggactacctggaccccgcctgcttcacccacagcttccactag

SEQ ID NO: 94565 - DNA, 594 bp, Artificial Sequence
  Description of Artificial Sequence: Synthetic coding sequence
atgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcggcgaccccctgatgctgggcgccagccactacaagaacctgaagagctacagacccagaaagatcagcagccagggcagactggccgtgttcaccaaggccaccctgaccaccgtgcagtag

SEQ ID NO: 94566 - DNA, 312 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgtag

SEQ ID NO: 94567 - DNA, 189 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgtag

SEQ ID NO: 94568 - DNA, 336 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagctag

SEQ ID NO: 94569 - DNA, 1566 bp, Artificial Sequence; identical to SEQ ID NO: 94562
  Description of Artificial Sequence: Synthetic coding sequence

SEQ ID NO: 94570 - DNA, 867 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggaggtgaccccctag

SEQ ID NO: 94571 - DNA, 363 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggactag

SEQ ID NO: 94572 - DNA, 105 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttctag

SEQ ID NO: 94573 - DNA, 930 bp, Artificial Sequence
  Description of Artificial Sequence: Synthetic coding sequence
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggaggacagactgtgcacccccggcagatgctgcgtgagcaccggcctgaccgacctggactacagctgcagcacctag

SEQ ID NO: 94574 - DNA, 1254 bp, Artificial Sequence
  Description of Artificial Sequence: Synthetic coding sequence
atgggcagaagaagagcccccgagctgtacagagcccccttccccctgtacgccctgcaggtggaccccagcaccggcctgctgatcgccgccggcggcggcggcgccgccaagaccggcatcaagaacggcgtgcacttcctgcagctggagctgatcaacggcagactgagcgccagcctgctgcacagccacgacaccgagaccagagccaccatgaacctggccctggccggcgacatcctggccgccggccaggacgcccactgccagctgctgagattccaggcccaccagcagcagggcaacaaggccgagaaggccggcagcaaggagcagggccccagacagagaaagggcgccgcccccgccgagaagaagtgcggcgccgagacccagcacgagggcctggagctgagagtggagaacctgcaggccgtgcagaccgacttcagcagcgaccccctgcagaaggtggtgtgcttcaaccacgacaacaccctgctggccaccggcggcaccgacggctacgtgagagtgtggaaggtgcccagcctggagaaggtgctggagttcaaggcccacgagggcgagatcgaggacctggccctgggccccgacggcaagctggtgaccgtgggcagagacctgaaggccagcgtgtggcagaaggaccagctggtgacccagctgcactggcaggagaacggccccaccttcagcagcaccccctacagataccaggcctgcagattcggccaggtgcccgaccagcccgccggcctgagactgttcaccgtgcagatcccccacaagagactgagacagccccccccctgctacctgaccgcctgggacggcagcaacttcctgcccctgagaaccaagagctgcggccacgaggtggtgagctgcctggacgtgagcgagagcggcaccttcctgggcctgggcaccgtgaccggcagcgtggccatctacatcgccttcagcctgcagtgcctgtactacgtgagagaggcccacggcatcgtggtgaccgacgtggccttcctgcccgagaagggcagaggccccgagctgctgggcagccacgagaccgccctgttcagcgtggccgtggacagcagatgccagctgcacctgctgcccagcagaagaagcgtgcccgtgtggctgctgctgctgctgtgcgtgggcctgatcatcgtgaccatcctgctgctgcagagcgccttccccggcttcctgtag

SEQ ID NO: 94575 - DNA, 1254 bp, Artificial Sequence; identical to SEQ ID NO: 94574
  Description of Artificial Sequence: Synthetic coding sequence

SEQ ID NO: 94576 - DNA, 441 bp, Artificial Sequence
  Description of Artificial Sequence: Synthetic coding sequence
atgagactgctgcagctgctgttcagagccagccccgccaccctgctgctggtgctgtgcctgcagctgggcgccaacaaggcccaggacaacaccagaaagatcatcatcaagaacttcgacatccccaagagcgtgagacccaacgacgaggtgaccgccgtgctggccgtgcagaccgagctgaaggagtgcatggtggtgaagacctacctgatcagcagcatccccctgcagggcgccttcaactacaagtacaccgcctgcctgtgcgacgacaaccccaagaccttctactgggacttctacaccaacagaaccgtgcagatcgccgccgtggtggacgtgatcagagagctgggcatctgccccgacgacgccgccgtgatccccatcaagaacaacagattctacaccatcgagatcctgaaggtggagtag

SEQ ID NO: 94577 - DNA, 1185 bp, Artificial Sequence
  Description of Artificial Sequence: Synthetic coding sequence
atgagcggcgaggacgagcagcaggagcagaccatcgccgaggacctggtggtgaccaagtacaagatgggcggcgacatcgccaacagagtgctgagaagcctggtggaggccagcagcagcggcgtgagcgtgctgagcctgtgcgagaagggcgacgccatgatcatggaggagaccggcaagatcttcaagaaggagaaggagatgaagaagggcatcgccttccccaccagcatcagcgtgaacaactgcgtgtgccacttcagccccctgaagagcgaccaggactacatcctgaaggagggcgacctggtgaagatcgacctgggcgtgcacgtggacggcttcatcgccaacgtggcccacaccttcgtggtggacgtggcccagggcacccaggtgaccggcagaaaggccgacgtgatcaaggccgcccacctgtgcgccgaggccgccctgagactggtgaagcccggcaaccagaacacccaggtgaccgaggcctggaacaaggtggcccacagcttcaactgcacccccatcgagggcatgctgagccaccagctgaagcagcacgtgatcgacggcgagaagaccatcatccagaaccccaccgaccagcagaagaaggaccacgagaaggccgagttcgaggtgcacgaggtgtacgccgtggacgtgctggtgagcagcggcgagggcaaggccaaggacgccggccagagaaccaccatctacaagagagaccccagcaagcagtacggcctgaagatgaagaccagcagagccttcttcagcgaggtggagagaagattcgacgccatgcccttcaccctgagagccttcgaggacgagaagaaggccagaatgggcgtggtggagtgcgccaagcacgagctgctgcagcccttcaacgtgctgtacgagaaggagggcgagttcgtggcccagttcaagttcaccgtgctgctgatgcccaacggccccatgagaatcaccagcggccccttcgagcccgacctgtacaagagcgagatggaggtgcaggacgccgagctgaaggccctgctgcagagcagcgccagcagaaagacccagaagaagaagaagaagaaggccagcaagaccgccgagaacgccaccagcggcgagaccctggaggagaacgaggccggcgactag

SEQ ID NO: 94578 - DNA, 1218 bp, Artificial Sequence
  Description of Artificial Sequence: Synthetic coding sequence
gcctgccccgccccccagcccgccagaagccagctgctggccctggcctgcctgcccgcccccctgctggccagagccttcgccagacccctgctggaggacagaggcgacagcgaccacagccccgaggacctggtggtgaccaagtacaagatgggcggcgacatcgccaacagagtgctgagaagcctggtggaggccagcagcagcggcgtgagcgtgctgagcctgtgcgagaagggcgacgccatgatcatggaggagaccggcaagatcttcaagaaggagaaggagatgaagaagggcatcgccttccccaccagcatcagcgtgaacaactgcgtgtgccacttcagccccctgaagagcgaccaggactacatcctgaaggagggcgacctggtgaagatcgacctgggcgtgcacgtggacggcttcatcgccaacgtggcccacaccttcgtggtggacgtggcccagggcacccaggtgaccggcagaaaggccgacgtgatcaaggccgcccacctgtgcgccgaggccgccctgagactggtgaagcccggcaaccagaacacccaggtgaccgaggcctggaacaaggtggcccacagcttcaactgcacccccatcgagggcatgctgagccaccagctgaagcagcacgtgatcgacggcgagaagaccatcatccagaaccccaccgaccagcagaagaaggaccacgagaaggccgagttcgaggtgcacgaggtgtacgccgtggacgtgctggtgagcagcggcgagggcaaggccaaggacgccggccagagaaccaccatctacaagagagaccccagcaagcagtacggcctgaagatgaagaccagcagagccttcttcagcgaggtggagagaagattcgacgccatgcccttcaccctgagagccttcgaggacgagaagaaggccagaatgggcgtggtggagtgcgccaagcacgagctgctgcagcccttcaacgtgctgtacgagaaggagggcgagttcgtggcccagttcaagttcaccgtgctgctgatgcccaacggccccatgagaatcaccagcggccccttcgagcccgacctgtacaagagcgagatggaggtgcaggacgccgagctgaaggccctgctgcagagcagcgccagcagaaagacccagaagaagaagaagaagaagaagaagaagtag

SEQ ID NO: 94579 - DNA, 738 bp, Artificial Sequence
  Description of Artificial Sequence: Synthetic coding sequence
atgaccagaatgctgcagagaatggacgtgctggccaagaaggccaccgagatgggcgtgagactgatggtggacgccgagcagacctacttccagcccgccatcagcagactgaccctggagatgcagagaaagttcaacgtggagaagcccctgatcttcaacacctaccagtgctacctgaaggacgcctacgacaacgtgaccctggacgtggagctggccagaagagagggctggtgcttcggcgccaagctggtgagaggcgcctacctggcccaggagagagccagagccgccgagatcggctacgaggaccccatcaaccccacctacgaggccaccaacgccatgtaccacagatgcctggactacgtgctggaggagctgaagcacaacgccaaggccaaggtgatggtggccagccacaacgaggacaccgtgagattcgccctgagaagaatggaggagctgggcctgcaccccgccgaccacagagtgtacttcggccagctgctgggcatgtgcgaccagatcagcttccccctgggccaggccggctaccccgtgtacaagtacgtgccctacggccccgtgatggaggtgctgccctacctgagcagaagagccctggagaacagcagcctgatgaagggcacccacagagagagacagctgctgtggctggagctgctgagaagactgagaaccggcaacctgttccacagacccgcctag

SEQ ID NO: 94580 - DNA, 1803 bp, Artificial Sequence
  Description of Artificial Sequence: Synthetic coding sequence
atggccctgagaagagccctgcccgccctgagaccctgcatccccagattcgtgcccctgagcaccgcccccgccagcagagagcagcccgccgccggccccgccgccgtgcccggcggcggcagcgccaccgccgtgagaccccccgtgcccgccgtggacttcggcaacgcccaggaggcctacagaagcagaagaacctgggagctggccagaagcctgctggtgctgagactgtgcgcctggcccgccctgctggccagacacgagcagctgctgtacgtgagcagaaagctgctgggccagagactgttcaacaagctgatgaagatgaccttctacggccacttcgtggccggcgaggaccaggagagcatccagcccctgctgagacactacagagccttcggcgtgagcgccatcctggactacggcgtggaggaggacctgagccccgaggaggccgagcacaaggagatggagagctgcaccagcgccgccgagagagacggcagcggcaccaacaagagagacaagcagtaccaggcccactgggccttcggcgacagaagaaacggcgtgatcagcgccagaacctacttctacgccaacgaggccaagtgcgacagccacatggagaccttcctgagatgcatcgaggccagcggcagagtgagcgacgacggcttcatcgccatcaagctgaccgccctgggcagaccccagttcctgctgcagttcagcgaggtgctggccaagtggagatgcttcttccaccagatggccgtggagcagggccaggccggcctggccgccatggacaccaagctggaggtggccgtgctgcaggagagcgtggccaagctgggcatcgccagcagagccgagatcgaggactggttcaccgccgagaccctgggcgtgagcggcaccatggacctgctggactggagcagcctgatcgacagcagaaccaagctgagcaagcacctggtggtgcccaacgcccagaccggccagctggagcccctgctgagcagattcaccgaggaggaggagctgcagatgaccagaatgctgcagagaatggacgtgctggccaagaaggccaccgagatgggcgtgagactgatggtggacgccgagcagacctacttccagcccgccatcagcagactgaccctggagatgcagagaaagttcaacgtggagaagcccctgatcttcaacacctaccagtgctacctgaaggacgcctacgacaacgtgaccctggacgtggagctggccagaagagagggctggtgcttcggcgccaagctggtgagaggcgcctacctggcccaggagagagccagagccgccgagatcggctacgaggaccccatcaaccccacctacgaggccaccaacgccatgtaccacagatgcctggactacgtgctggaggagctgaagcacaacgccaaggccaaggtgatggtggccagccacaacgaggacaccgtgagattcgccctgagaagaatggaggagctgggcctgcaccccgccgaccacagagtgtacttcggccagctgctgggcatgtgcgaccagatcagcttccccctgggccaggccggctaccccgtgtacaagtacgtgccctacggccccgtgatggaggtgctgccctacctgagcagaagagccctggagaacagcagcctgatgaagggcacccacagagagagacagctgctgtggctggagctgctgagaagactgagaaccggcaacctgttccacagacccgcctag

SEQ ID NO: 94581 - DNA, 1479 bp, Artificial Sequence
  Description of Artificial Sequence: Synthetic coding sequence
atgaagatgaccttctacggccacttcgtggccggcgaggaccaggagagcatccagcccctgctgagacactacagagccttcggcgtgagcgccatcctggactacggcgtggaggaggacctgagccccgaggaggccgagcacaaggagatggagagctgcaccagcgccgccgagagagacggcagcggcaccaacaagagagacaagcagtaccaggcccactgggccttcggcgacagaagaaacggcgtgatcagcgccagaacctacttctacgccaacgaggccaagtgcgacagccacatggagaccttcctgagatgcatcgaggccagcggcagagtgagcgacgacggcttcatcgccatcaagctgaccgccctgggcagaccccagttcctgctgcagttcagcgaggtgctggccaagtggagatgcttcttccaccagatggccgtggagcagggccaggccggcctggccgccatggacaccaagctggaggtggccgtgctgcaggagagcgtggccaagctgggcatcgccagcagagccgagatcgaggactggttcaccgccgagaccctgggcgtgagcggcaccatggacctgctggactggagcagcctgatcgacagcagaaccaagctgagcaagcacctggtggtgcccaacgcccagaccggccagctggagcccctgctgagcagattcaccgaggaggaggagctgcagatgaccagaatgctgcagagaatggacgtgctggccaagaaggccaccgagatgggcgtgagactgatggtggacgccgagcagacctacttccagcccgccatcagcagactgaccctggagatgcagagaaagttcaacgtggagaagcccctgatcttcaacacctaccagtgctacctgaaggacgcctacgacaacgtgaccctggacgtggagctggccagaagagagggctggtgcttcggcgccaagctggtgagaggcgcctacctggcccaggagagagccagagccgccgagatcggctacgaggaccccatcaaccccacctacgaggccaccaacgccatgtaccacagatgcctggactacgtgctggaggagctgaagcacaacgccaaggccaaggtgatggtggccagccacaacgaggacaccgtgagattcgccctgagaagaatggaggagctgggcctgcaccccgccgaccacagagtgtacttcggccagctgctgggcatgtgcgaccagatcagcttccccctgggccaggccggctaccccgtgtacaagtacgtgccctacggccccgtgatggaggtgctgccctacctgagcagaagagccctggagaacagcagcctgatgaagggcacccacagagagagacagctgctgtggctggagctgctgagaagactgagaaccggcaacctgttccacagacccgcctag

SEQ ID NO: 94582 - DNA, 1611 bp, Artificial Sequence
  Description of Artificial Sequence: Synthetic coding sequence
atgagccccagagtggtgagcaacagcagcgtgctggccagccagagcgtgggcatcaccaacgtgagaaccgtgttcagcaacgtgttcaacaacaccaccgccttccccatcctgagaggcagcaactgccacaagatcaccgcccccggcctgggcaagggccagctggtgaacctgctgccccccgagaacctgccctggtgcggcggcagccagggccccagaatgctgagaacctgctacgtgctgtgcagccaggccggcccccccagcagaggctggcagagcctgagcttcgacggcggcgccttccacctgaagggcaccggcgagctgaccagagccctgctggtgctgagactgtgcgcctggccccccctggtgacccacggcctgctgctgcaggcctggagcagaagactgctgggcagcagactgagcggcgccttcctgagagccagcgtgtacggccagttcgtggccggcgagaccgccgaggaggtgaagggctgcgtgcagcagctgagaaccctgagcctgagacccctgctggccgtgcccaccgaggaggagcccgacagcgccgccaagagcggcgaggcctggtacgagggcaacctgggcgccatgctgagatgcgtggacctgagcagaggcctgctggagccccccagcctggccgaggccagcctgatgcagctgaaggtgaccgccctgaccagcaccagactgtgcaaggagctggccagctgggtgagaagacccggcgccagcctggagctgagccccgagagactggccgaggccatggacagcggccagaacctgcaggtgagctgcctgaacgccgagcagaaccagcacctgagagccagcctgagcagactgcacagagtggcccagtacgccagagcccagcacgtgagactgctggtggacgccgagtacaccagcctgaaccccgccctgagcctgctggtggccgccctggccgtgagatggaacagccccggcgagggcggcccctgggtgtggaacacctaccaggcctgcctgaaggacaccttcgagagactgggcagagacgccgaggccgcccacagagccggcctggccttcggcgtgaagctggtgagaggcgcctacctggacaaggagagagccgtggcccagctgcacggcatggaggaccccacccagcccgactacgaggccaccagccagagctacagcagatgcctggagctgatgctgacccacgtggccagacacggccccatgtgccacctgatggtggccagccacaacgaggagagcgtgagacaggccaccaagagaatgtgggagctgggcatccccctggacggcaccgtgtgcttcggccagctgctgggcatgtgcgaccacgtgagcctggccctgggccaggccggctacgtggtgtacaagagcatcccctacggcagcctggaggaggtgatcccctacctgatcagaagagcccaggagaacagaagcgtgctgcagggcgccagaagagagcaggagctgctgagccaggagctgtggagaagactgctgcccggctgcagaagaatcccccactag

SEQ ID NO: 94583 - DNA, 762 bp, Artificial Sequence
  Description of Artificial Sequence: Synthetic coding sequence
atgcccggcagaaccgagggcggcagctggctgagaaacgccgccgccgccgacgtgctgagaaacctgcccgaggtggagtggagagagccccagcactgctgcccccccacccccagaaagagaaagcagaaccccagagtgcccctgccccactacccccccaaccccgccgccgccatcgccgccgacaccatgcccaagagaaagaagcagaaccaccaccagccccccacccagcagcagccccccctgcccgagagagaggagaccggcgacgaggaggacggcagccccatcggcccccccagcctgctgggccccccccccatggccaacggcaagcccggcgaccccaagagcgccctgcacagaggcccccccggcagcagaggccccctgatcccccccctgctgagcctgcccccccccccctggggcagaggccccatcagaagaggcctgggccccagaagcagcccctacggcagaggctggtggggcgtgaacgccgagccccccttccccggccccggccacggcggccccaccagaggcagcttccacaaggagcagagaaaccccagaagactgaagagctggagcctgatcaagaacacctgcccccccaaggacgacccccaggtgatggaggacaagagcgacagacccgtgtgcagacacttcgccaagaagggccactgcagatacgaggacctgtgcgccttctaccaccccggcgtgaacggcccccccctgtag

SEQ ID NO: 94584 - DNA, 504 bp, Artificial Sequence
  Description of Artificial Sequence: Synthetic coding sequence
atgcccaagagaaagaagcagaaccaccaccagccccccacccagcagcagccccccctgcccgagagagaggagaccggcgacgaggaggacggcagccccatcgccctgcacagaggcccccccggcagcagaggccccctgatcccccccctgctgagcctgcccccccccccctggggcagaggccccatcagaagaggcctgggccccagaagcagcccctacggcagaggctggtggggcgtgaacgccgagccccccttccccggccccggccacggcggccccaccagaggcagcttccacaaggagcagagaaaccccagaagactgaagagctggagcctgatcaagaacacctgcccccccaaggacgacccccaggtgatggaggacaagagcgacagacccgtgtgcagacacttcgccaagaagggccactgcagatacgaggacctgtgcgccttctaccaccccggcgtgaacggcccccccctgtag

SEQ ID NO: 94585 - DNA, 567 bp, Artificial Sequence
  Description of Artificial Sequence: Synthetic coding sequence
atgcccaagagaaagaagcagaaccaccaccagccccccacccagcagcagccccccctgcccgagagagaggagaccggcgacgaggaggacggcagccccatcggcccccccagcctgctgggccccccccccatggccaacggcaagcccggcgaccccaagagcgccctgcacagaggcccccccggcagcagaggccccctgatcccccccctgctgagcctgcccccccccccctggggcagaggccccatcagaagaggcctgggccccagaagcagcccctacggcagaggctggtggggcgtgaacgccgagccccccttccccggccccggccacggcggccccaccagaggcagcttccacaaggagcagagaaaccccagaagactgaagagctggagcctgatcaagaacacctgcccccccaaggacgacccccaggtgatggaggacaagagcgacagacccgtgtgcagacacttcgccaagaagggccactgcagatacgaggacctgtgcgccttctaccaccccggcgtgaacggcccccccctgtag

SEQ ID NO: 94586 - DNA, 567 bp, Artificial Sequence; identical to SEQ ID NO: 94585
  Description of Artificial Sequence: Synthetic coding sequence

SEQ ID NO: 94587 - DNA, 504 bp, Artificial Sequence; identical to SEQ ID NO: 94584
  Description of Artificial Sequence: Synthetic coding sequence

SEQ ID NO: 94588 - DNA, 504 bp, Artificial Sequence; identical to SEQ ID NO: 94584
  Description of Artificial Sequence: Synthetic coding sequence

SEQ ID NO: 94589 - DNA, 504 bp, Artificial Sequence; identical to SEQ ID NO: 94584
  Description of Artificial Sequence: Synthetic coding sequence

SEQ ID NO: 94590 - DNA, 567 bp, Artificial Sequence; identical to SEQ ID NO: 94585
  Description of Artificial Sequence: Synthetic coding sequence

SEQ ID NO: 94591 - DNA, 567 bp, Artificial Sequence; identical to SEQ ID NO: 94585
  Description of Artificial Sequence: Synthetic coding sequence

SEQ ID NO: 94592 - DNA, 504 bp, Artificial Sequence; identical to SEQ ID NO: 94584
  Description of Artificial Sequence: Synthetic coding sequence

SEQ ID NO: 94593 - DNA, 504 bp, Artificial Sequence; identical to SEQ ID NO: 94584
  Description of Artificial Sequence: Synthetic coding sequence

SEQ ID NO: 94594 - DNA, 504 bp, Artificial Sequence; identical to SEQ ID NO: 94584
  Description of Artificial Sequence: Synthetic coding sequence

SEQ ID NO: 94595 - DNA, 567 bp, Artificial Sequence; identical to SEQ ID NO: 94585
  Description of Artificial Sequence: Synthetic coding sequence

SEQ ID NO: 94596 - DNA, 567 bp, Artificial Sequence; identical to SEQ ID NO: 94585
  Description of Artificial Sequence: Synthetic coding sequence

SEQ ID NO: 94597 - DNA, 567 bp, Artificial Sequence; identical to SEQ ID NO: 94585
  Description of Artificial Sequence: Synthetic coding sequence

SEQ ID NO: 94598 - DNA, 762 bp, Artificial Sequence; identical to SEQ ID NO: 94583
  Description of Artificial Sequence: Synthetic coding sequence

SEQ ID NO: 94599 - DNA, 762 bp, Artificial Sequence; identical to SEQ ID NO: 94583
  Description of Artificial Sequence: Synthetic coding sequence

SEQ ID NO: 94600 - DNA, 762 bp, Artificial Sequence; identical to SEQ ID NO: 94583
  Description of Artificial Sequence: Synthetic coding sequence

SEQ ID NO: 94601 - DNA, 762 bp, Artificial Sequence; identical to SEQ ID NO: 94583
  Description of Artificial Sequence: Synthetic coding sequence

SEQ ID NO: 94602 - DNA, 762 bp, Artificial Sequence; identical to SEQ ID NO: 94583
  Description of Artificial Sequence: Synthetic coding sequence

SEQ ID NO: 94603 - DNA, 762 bp, Artificial Sequence; identical to SEQ ID NO: 94583
  Description of Artificial Sequence: Synthetic coding sequence

SEQ ID NO: 94604 - DNA, 1344 bp, Artificial Sequence
  Description of Artificial Sequence: Synthetic coding sequence
atgagaagcgtgagctacgtgcagagagtggccctggagttcagcggcagcctgttcccccacgccatctgcctgggcgacgtggacaacgacaccctgaacgagctggtggtgggcgacaccagcggcaaggtgagcgtgtacaagaacgacgacagcagaccctggctgacctgcagctgccagggcatgctgacctgcgtgggcgtgggcgacgtgtgcaacaagggcaagaacctgctggtggccgtgagcgccgagggctggttccacctgttcgacctgacccccgccaaggtgctggacgccagcggccaccacgagaccctgatcggcgaggagcagagacccgtgttcaagcagcacatccccgccaacaccaaggtgatgctgatcagcgacatcgacggcgacggctgcagagagctggtggtgggctacaccgacagagtggtgagagccttcagatgggaggagctgggcgagggccccgagcacctgaccggccagctggtgagcctgaagaagtggatgctggagggccaggtggacagcctgagcgtgaccctgggccccctgggcctgcccgagctgatggtgagccagcccggctgcgcctacgccatcctgctgtgcacctggaagaaggacaccggcagcccccccgccagcgagggccccaccgacggcagcagagagacccccgccgccagagacgtggtgctgcaccagaccagcggcagaatccacaacaagaacgtgagcacccacctgatcggcaacatcaagcagggccacggcaccgagagcagcggcagcggcctgttcgccctgtgcaccctggacggcaccctgaagctgatggaggagatggaggaggccgacaagctgctgtggagcgtgcaggtggaccaccagctgttcgccctggagaagctggacgtgaccggcaacggccacgaggaggtggtggcctgcgcctgggacggccagacctacatcatcgaccacaacagaaccgtggtgagattccaggtggacgagaacatcagagccttctgcgccggcctgtacgcctgcaaggagggcagaaacagcccctgcctggtgtacgtgaccttcaaccagaagatctacgtgtactgggaggtgcagctggagagaatggagagcaccaacctggtgaagctgctggagaccaagcccgagtaccacagcctgctgcaggagctgggcgtggaccccgacgacctgcccgtgaccagagccctgctgcaccagaccctgtaccaccccgaccagcccccccagtgcgcccccagcagcctgcaggaccccacctag

SEQ ID NO: 94605 - DNA, 381 bp, Artificial Sequence
  Description of Artificial Sequence: Synthetic coding sequence
atgctgctggtgctgctgagcgtggtgctgctggccctgagcagcgcccagagcaccgacaacgacgtgaactacgaggacttcaccttcaccatccccgacgtggaggacagctacctggaccccctggtgatcgtggtgaccaagatgatggtgctgagcagagaccaccagaaccaggaggccatcaccgccatcctgccccacctgctgttcaagatcagcaacgaccaccccgacgaggacaccgtgaacagcctgtaccccgacttcctgctgagcgcctgcagaaagcaccaccacagcagcagaggcaccgaccagcaggacatccccagaagcaaccacagcggcaacctggagttcagcggcagaaagtag

SEQ ID NO: 94606 - DNA, 198 bp, Artificial Sequence
  Description of Artificial Sequence: Synthetic coding sequence
atgctgctggtgctgctgagcgtggtgctgctggccctgagcagcgcccagagcaccgacaacgacgtgaactacgaggacttcaccttcaccatccccgcctgcagaaagcaccaccacagcagcagaggcaccgaccagcaggacatccccagaagcaaccacagcggcaacctggagttcagcggcagaaagtag

SEQ ID NO: 94607 - DNA, 696 bp, Artificial Sequence
  Description of Artificial Sequence: Synthetic coding sequence
atggccgtgttcctggaggccaaggacgcccacagcgtgctgaagagattccccagagccaacgagttcctggaggagctgagacagggcaccatcgagagagagtgcatggaggagatctgcagctacgaggaggtgaaggaggtgttcgagaacaaggagaagaccatggagttctggaagggctaccccaacgccgtgtacagcgtgagagaccccagccagagcagcgacgccatgtacgtggtggtgcccctgctgggcgtggccctgctgatcgtgatcgccctgttcatcatctggagatgccagctgcagaaggccaccagacaccaccccagctacgcccagaacagatacctggccagcagagccggccacaccctgcccagagtgatggtgtacagaggcaccgtgcacagccagggcgagcccagcggccacagagaggccgccaacagcccccaggtggtgctgggccccagcagaggcggcagaaccaccgtgagactggagagcaccctgtacctgcccgagctgagcctgagcagactgagcagcaccacccccccccccagctacgaggaggtgaccgccccccaggagagcagcagcgaggaggccagcgtgagctacagcgaccccccccccaagtacgaggagatcgtggccgccaaccccggcgccgacaagtag

SEQ ID NO: 94608 - DNA, 309 bp, Artificial Sequence
  Description of Artificial Sequence: Synthetic coding sequence
atggccggcctgagcagagccctgagcagcgtgttcctggaggccaaggacgcccacagcgtgctgaagagattccccagagccaacgagttcctggaggagctgagacagggcaccatcgagagagagtgcatggaggagatctgcagctacgaggaggtgaaggaggtgttcgagaacaaggagaagaccgcctgcaccaccctgggcctggtgctgggcgtgggcgtggccagcggcatcgccagaaccggccccggcaacgccgaccagagcgaggccagaaaggacacccagcccaaggcctag

SEQ ID NO: 94609 - DNA, 276 bp, Artificial Sequence
  Description of Artificial Sequence: Synthetic coding sequence
gaccccagccagagcagcgacgccatgtacgtggtggtgcccctgctgggcgtggccctgctgatcgtgatcgccctgttcatcatctggagatgccagctgcagaaggccaccagacaccaccccagctacgcccagaacagaagatgcttcgccgtgagactggccgcccccagcttcgccagcaagtacagcaacgtgggcgccttccccttcagactgtgggccgccagcctgagcctggccagaatctacctgaccaacatccccaagtag

SEQ ID NO: 94610 - DNA, 159 bp, Artificial Sequence
  Description of Artificial Sequence: Synthetic coding sequence
atggccgtgttcctggaggccaaggacgcccacagcgtgctgaagagattccccagagccaacgagttcctggaggagctgagacagggcaccatcgagagagagtgcatggaggagatctgcagctacgaggaggtgaaggaggtgttcgagaactag

SEQ ID NO: 94611 - DNA, 696 bp, Artificial Sequence; identical to SEQ ID NO: 94607
  Description of Artificial Sequence: Synthetic coding sequence

SEQ ID NO: 94612 - DNA, 681 bp, Artificial Sequence
  Description of Artificial Sequence: Synthetic coding sequence
atgttcaccctgctggtgctgctgagccagctgcccaccgtgaccctgggcttcccccactgcgccagaggccccaaggccagcaagcacgccggcgaggaggtgttcaccagcaaggaggaggccaacttcttcatccacagaagactgctgtacaacagattcgacctggagctgttcacccccggcaacctggagagagagtgcaacgaggagctgtgcaactacgaggaggccagagagatcttcgtggacgaggacaagaccatcgccttctggcaggagtacagcgccaagggccccaccaccaagagcgacggcaacagagagaagatcgacgtgatgggcctgctgaccggcctgatcgccgccggcgtgttcctggtgatcttcggcctgctgggctactacctgtgcatcaccaagtgcaacagactgcagcacccctgcagcagcgccgtgtacgagagaggcagacacacccccagcatcatcttcagaagacccgaggaggccgccctgagccccctgccccccagcgtggaggacgccggcctgcccagctacgagcaggccgtggccctgaccagaaagcacagcgtgagccccccccccccctaccccggccacaccaagggcttcagagtgttcaagaagagcatgagcctgcccagccactag

SEQ ID NO: 94613 - DNA, 375 bp, Artificial Sequence
  Description of Artificial Sequence: Synthetic coding sequence
atgctgctgagagacctggtgctgagaagaggctgctgctggagcagcctgctgctgcactgcgccctgcaccccctgtggggcttcgtgcaggtgacccacggcgagccccagaagagctgcagcaaggtgaccgacagctgcagacacgtgtgccagtgcagaccccccccccccctgccccccccccccccccccccccccccccccagactgctgagcgcccccgcccccaacagcaccagctgccccaccgaggagagctggtggagcggcctggtgatcatcatcgccgtgtgctgcgccagcctggtgttcctgaccgtgctggtgatcatctgctacaaggccatcaagagaaaccacgccatctag

SEQ ID NO: 94614 - DNA, 462 bp, Artificial Sequence
  Description of Artificial Sequence: Synthetic coding sequence
atgctgctgagagacctggtgctgagaagaggctgctgctggagcagcctgctgctgcactgcgccctgcaccccctgtggggcttcgtgcaggtgacccacggcgagccccagaagagctgcagcaaggtgaccgacagctgcagacacgtgtgccagtgcagaccccccccccccctgccccccccccccccccccccccccccccccagactgctgagcgcccccgcccccaacagcaccagctgccccaccgaggagagctggtggagcggcctggtgatcatcatcgccgtgtgctgcgccagcctggtgttcctgaccgtgctggtgatcatctgctacaaggccatcaagagaaagcccctgagaaaggacgagaacggcaccagcgtggccgagtaccccatgagcgccagccagagcaacaagggcgtggacgtgaacaacgccgtggtgtag

SEQ ID NO: 94615 - DNA, 462 bp, Artificial Sequence; identical to SEQ ID NO: 94614
  Description of Artificial Sequence: Synthetic coding sequence

SEQ ID NO: 94616 - DNA, 828 bp, Artificial Sequence
  Description of Artificial Sequence: Synthetic coding sequence
atgtggagagccggcagcatgagcgccgagctgggcgtgggctgcgccctgagagccgtgaacgagagagtgcagcaggccgtggccagaagacccagagacctgcccgccatccagcccagactggtggccgtgagcaagaccaagcccgccgacatggtgatcgaggcctacggccacggccagagaaccttcggcgagaactacgtgcaggagctgctggagaaggccagcaaccccaagatcctgagcctgtgccccgagatcaagtggcacttcatcggccacctgcagaagcagaacgtgaacaagctgatggccgtgcccaacctgttcatgctggagaccgtggacagcgtgaagctggccgacaaggtgaacagcagctggcagagaaagggcagccccgagagactgaaggtgatggtgcagatcaacaccagcggcgaggagagcaagcacggcctgccccccagcgagaccatcgccatcgtggagcacatcaacgccaagtgccccaacctggagttcgtgggcctgatgaccatcggcagcttcggccacgacctgagccagggccccaaccccgacttccagctgctgctgagcctgagagaggagctgtgcaagaagctgaacatccccgccgaccaggtggagctgagcatgggcatgagcgccgacttccagcacgccgtggaggtgggcagcaccaacgtgagaatcggcagcaccatcttcggcgagagagactacagcaagaagcccacccccgacaagtgcgccgccgacgtgaaggcccccctggaggtggcccaggagcactag

SEQ ID NO: 94617 - DNA, 1149 bp, Artificial Sequence
  Description of Artificial Sequence: Synthetic coding sequence
atgagaagccccctgtgctggctgctgcccctgctgatcctggccagcgtggcccagggccagcccaccagaagacccagacccggcaccggccccggcagaagacccagacccagacccagacccacccccagcttcccccagcccgacgagcccgccgagcccaccgacctgcccccccccctgccccccggcccccccagcatcttccccgactgccccagagagtgctactgcccccccgacttccccagcgccctgtactgcgacagcagaaacctgagaaaggtgcccgtgatcccccccagaatccactacctgtacctgcagaacaacttcatcaccgagctgcccgtggagagcttccagaacgccaccggcctgagatggatcaacctggacaacaacagaatcagaaagatcgaccagagagtgctggagaagctgcccggcctggtgttcctgtacatggagaagaaccagctggaggaggtgcccagcgccctgcccagaaacctggagcagctgagactgagccagaaccacatcagcagaatcccccccggcgtgttcagcaagctggagaacctgctgctgctggacctgcagcacaacagactgagcgacggcgtgttcaagcccgacaccttccacggcctgaagaacctgatgcagctgaacctggcccacaacatcctgagaaagatgccccccagagtgcccaccgccatccaccagctgtacctggacagcaacaagatcgagaccatccccaacggctacttcaagagcttccccaacctggccttcatcagactgaactacaacaagctgaccgacagaggcctgcccaagaacagcttcaacatcagcaacctgctggtgctgcacctgagccacaacagaatcagcagcgtgcccgccatcaacaacagactggagcacctgtacctgaacaacaacagcatcgagaagatcaacggcacccagatctgccccaacgacctggtggccttccacgacttcagcagcgacctggagaacgtgccccacctgagatacctgagactggacggcaactacctgaagccccccatccccctggacctgatgatgtgcttcagactgctgcagagcgtggtgatctag

SEQ ID NO: 94618 - DNA, 1002 bp, Artificial Sequence
  Description of Artificial Sequence: Synthetic coding sequence
atggaggacctggaggaggacgtgagattcatcgtggacgagaccctggacttcggcggcctgagccccagcgacagcagagaggaggaggacatcaccgtgctggtgacccccgagaagcccctgagaagaggcctgagccacagaagcgaccccaacgccgtggcccccgccccccagggcgtgagactgagcctgggccccctgagccccgagaagctggaggagatcctggacgaggccaacagactggccgcccagctggagcagtgcgccctgcaggacagagagagcgccggcgagggcctgggccccagaagagtgaagcccagccccagaagagagaccttcgtgctgaaggacagccccgtgagagacctgctgcccaccgtgaacagcctgaccagaagcacccccagccccagcagcctgacccccagactgagaagcaacgacagaaagggcagcgtgagagccctgagagccaccagcggcaagagacccagcaacatgaagagagagagccccacctgcaacctgttccccgccagcaagagccccgccagcagccccctgaccagaagcaccccccccgtgagaggcagagccggccccagcggcagagccgccgccagcccccccacccccatcagaagcgtgctggccccccagcccagcaccagcaacagccagagactgcccagaccccagggcgccgccgccaagagcagcagccagctgcccatccccagcgccatccccagacccgccagcagaatgcccctgaccagcagaagcgtgccccccggcagaggcgccctgccccccgacagcctgagcaccagaaagggcctgcccagacccagcaccgccggccacagagtgagagagagcggccacaaggtgcccgtgagccagagactgaacctgcccgtgatgggcgccaccagaagcaacctgcagccccccagaaaggtggccgtgcccggccccaccagatag

SEQ ID NO: 94619 - DNA, 933 bp, Artificial Sequence
  Description of Artificial Sequence: Synthetic coding sequence
atggaggacctggaggaggacgtgagattcatcgtggacgagaccctggacttcggcggcctgagccccagcgacagcagagaggaggaggacatcaccgtgctggtgacccccgagaagcccctgagaagaggcctgagccacagaagcgaccccaacgccgtggcccccgccccccagggcgtgagactgagcctgggccccctgagccccgagaagctggaggagatcctggacgaggccaacagactggccgcccagctggagcagtgcgccctgcaggacagagagagcgccggcgagggcctgggccccagaagagtgaagcccagccccagaagagagaccttcgtgctgaaggacagccccgtgagagacctgctgcccaccgtgaacagcctgaccagaagcacccccagccccagcagcctgacccccagactgagaagcaacgacagaaagggcagcgtgagagccctgagagccaccagcggcaagagacccagcaacatgaagagagagagccccacctgcaacctgttccccgccagcaagagccccgccagcagccccctgaccagaagcaccccccccgtgagaggcagagccggccccagcggcagagccgccgccagcgaggagaccagagccgccaagctgagagcctgccagcccaacgccacccaccagcccgagtgcgccacctggcagagatgccccaccagcggcttcagcgtgaacagcaagagagccagcaagaccaagcactgcagaacccagagcgccggcaagtggacccagggcagctgcttccccgccaccaagagcagctgccacggctgccacagccagcagagcgccgccccccaggagagcggcagccccagaacctaccaggtgaagagaagcggccagcaggccagactgcagtag

SEQ ID NO: 94620 - DNA, 1002 bp, Artificial Sequence; identical to SEQ ID NO: 94618
  Description of Artificial Sequence: Synthetic coding sequence

SEQ ID NO: 94621 - DNA, 1002 bp, Artificial Sequence; identical to SEQ ID NO: 94618
  Description of Artificial Sequence: Synthetic coding sequence

SEQ ID NO: 94622 - DNA, 1002 bp, Artificial Sequence; identical to SEQ ID NO: 94618
  Description of Artificial Sequence: Synthetic coding sequence

SEQ ID NO: 94623 - DNA, 666 bp, Artificial Sequence
  Description of Artificial Sequence: Synthetic coding sequence
atggaggacctggaggaggacgtgagattcatcgtggacgagaccctggacttcggcggcctgagccccagcgacagcagagaggaggaggacatcaccgtgctggtgacccccgagaagcccctgagaagaggcctgagccacagaagcgaccccaacgccgtggcccccgccccccagggcgtgagactgagcctgggccccctgagccccgagaagctggaggagatcctggacgaggccaacagactggccgcccagctggagcagtgcgccctgcaggacagagagagcgccggcgagggcctgggccccagaagagtgaagcccagccccagaagagagaccttcgtgctgaaggacagccccgtgagagacctgctgcccaccgtgaacagcctgaccagaagcacccccagccccagcagcctgacccccagactgagaagcaacgacagaaagggcagcgtgagagccctgagagccaccagcggcaagagacccagcaacatgaagagagagagccccacctgcaacctgttccccgccagcaagagccccgccagcagccccctgaccagaagcaccccccccgtgagaggcagagccggccccagcggcagagccgccgccagcgaggagaccagagccgccaagctgagatag

SEQ ID NO: 94624 - DNA, 699 bp, Artificial Sequence
  Description of Artificial Sequence: Synthetic coding sequence
atggaggacctggaggaggacgtgagattcatcgtggacgagaccctggacttcggcggcctgagccccagcgacagcagagaggaggaggacatcaccgtgctggtgacccccgagaagcccctgagaagaggcctgagccacagaagcgaccccaacgccgtggcccccgccccccagggcgtgagactgagcctgggccccctgagccccgagaagctggaggagatcctggacgaggccaacagactggccgcccagctggagcagtgcgccctgcaggacagagagagcgccggcgagggcctgggccccagaagagtgaagcccagccccagaagagagaccttcgtgctgaaggacagccccgtgagagacctgctgcccaccgtgaacagcctgaccagaagcacccccagccccagcagcctgacccccagactgagaagcaacgacagaaagggcagcgtgagagccctgagagccaccagcggcaagagacccagcaacatgaagagagagagccccacctgcaacctgttccccgccagcaagagccccgccagcagccccctgaccagaagcaccccccccgtgagaggcagagccggccccagcggcagagccgccgccagcccccccacccccatcagaagcgtgctggccccccagcccagcaccagcaacagccagagatag

SEQ ID NO: 94625 - DNA, 1092 bp, Artificial Sequence
  Description of Artificial Sequence: Synthetic coding sequence
atggaggacctggaggaggacgtgagattcatcgtggacgagaccctggacttcggcggcctgagccccagcgacagcagagaggaggaggacatcaccgtgctggtgacccccgagaagcccctgagaagaggcctgagccacagaagcgaccccaacgccgtggcccccgccccccagggcgtgagactgagcctgggccccctgagccccgagaagctggaggagatcctggacgaggccaacagactggccgcccagctggagcagtgcgccctgcaggacagagagagcgccggcgagggcctgggccccagaagagtgaagcccagccccagaagagagaccttcgtgctgaaggacagccccgtgagagacctgctgcccaccgtgaacagcctgaccagaagcacccccagccccagcagcctgacccccagactgagaagcaacgacagaaagggcagcgtgagagccctgagagccaccagcggcaagagacccagcaacatgaagagagagagccccacctgcaacctgttccccgccagcaagagccccgccagcagccccctgaccagaagcaccccccccgtgagaggcagagccggccccagcggcagagccgccgccagcgaggagaccagagccgccaagctgagagtgagcggcagcggcgagttcgtgggcctgaccctgaagttcctgcaccccagcccccccggcccccccacccccatcagaagcgtgctggccccccagcccagcaccagcaacagccagagactgcccagaccccagggcgccgccgccaagagcagcagccagctgcccatccccagcgccatccccagacccgccagcagaatgcccctgaccagcagaagcgtgccccccggcagaggcgccctgccccccgacagcctgagcaccagaaagggcctgcccagacccagcaccgccggccacagagtgagagagagcggccacaaggtgcccgtgagccagagactgaacctgcccgtgatgggcgccaccagaagcaacctgcagccccccagaaaggtggccgtgcccggccccaccagatag

SEQ ID NO: 94626 - DNA, 273 bp, Artificial Sequence
  Description of Artificial Sequence: Synthetic coding sequence
atgagaagactgctgctggtgaccagcctggtggtggtgctgctgtgggaggccggcgccgtgcccgcccccaaggtgcccatcaagatgcaggtgaagcactggcccagcgagcaggaccccgagaaggcctggggcgccagagtggtggagccccccgagaaggacgaccagctggtggtgctgttccccgtgcagaagcccaagctgctgaccaccgaggagaagcccagaggcaccaaggcctggatggagagcagagccagaccctag

SEQ ID NO: 94627 - DNA, 459 bp, Artificial Sequence
  Description of Artificial Sequence: Synthetic coding sequence
atgagaagactgctgctggtgaccagcctggtggtggtgctgctgtgggaggccggcgccgtgcccgcccccaaggtgcccatcaagatgcaggtgaagcactggcccagcgagcaggaccccgagaacagagcctggggcgccagagtggtggagccccccgagaaggacgaccagctggtggtgctgttccccgtgcagaagcccaagctgctgaccaccgaggagaagcccagaggccagggcagaggccccatcctgcccggcaccaaggcctggatggagaccgaggacaccctgggccacgtgctgagccccgagcccgaccacgacagcctgtaccaccccccccccgaggaggaccagggcgaggagagacccagactgtgggtgatgcccaaccaccaggtgctgctgggccccgaggaggaccaggaccacatctaccacccccagtag

SEQ ID NO: 94628 - DNA, 456 bp, Artificial Sequence
  Description of Artificial Sequence: Synthetic coding sequence
atgagaagactgctgctggtgaccagcctggtggtggtgctgctgtgggaggccggcgccgtgcccgcccccaaggtgcccatcaagatgcaggtgaagcactggcccagcgagcaggaccccgagaaggcctggggcgccagagtggtggagccccccgagaaggacgaccagctggtggtgctgttccccgtgcagaagcccaagctgctgaccaccgaggagaagcccagaggccagggcagaggccccatcctgcccggcaccaaggcctggatggagaccgaggacaccctgggccacgtgctgagccccgagcccgaccacgacagcctgtaccaccccccccccgaggaggaccagggcgaggagagacccagactgtgggtgatgcccaaccaccaggtgctgctgggccccgaggaggaccaggaccacatctaccacccccagtag

SEQ ID NO: 94629 - DNA, 429 bp, Artificial Sequence
  Description of Artificial Sequence: Synthetic coding sequence
atgagaagactgctgctggtgaccagcctggtggtggtgctgctgtgggaggccggcgccgtgcccgcccccaaggtgcccatcaagatgcaggtgaagcactggcccagcgagcaggaccccgagaaggcctggggcgccagagtggtggagccccccgagaaggacgaccagctggtggtgctgttccccgtgcagaagcccaagctgctgaccaccgaggagaagcccagaggcaccaaggcctggatggagaccgaggacaccctgggccacgtgctgagccccgagcccgaccacgacagcctgtaccaccccccccccgaggaggaccagggcgaggagagacccagactgtgggtgatgcccaaccaccaggtgctgctgggccccgaggaggaccaggaccacatctaccacccccagtag

SEQ ID NO: 94630 - DNA, 6474 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcctggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94631 - DNA, 4149 bp, Artificial Sequence
  Description of Artificial Sequence: Synthetic coding sequence
atgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcctggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94632 - DNA, 6474 bp, Artificial Sequence; identical to SEQ ID NO: 94630
  Description of Artificial Sequence: Synthetic coding sequence

SEQ ID NO: 94633 - DNA, 6474 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagcacaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgccccccccagcctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94634 - DNA, 6474 bp, Artificial Sequence; identical to SEQ ID NO: 94633
  Description of Artificial Sequence: Synthetic coding sequence

SEQ ID NO: 94635 - DNA, 6474 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94636 - DNA, 6474 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagcccctggagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94637 - DNA, 6474 bp, Artificial Sequence; identical to SEQ ID NO: 94633
  Description of Artificial Sequence: Synthetic coding sequence

SEQ ID NO: 94638 - DNA, 6450 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcctggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94639 - DNA, 6474 bp, Artificial Sequence; identical to SEQ ID NO: 94633
  Description of Artificial Sequence: Synthetic coding sequence

SEQ ID NO: 94640 - DNA, 6474 bp, Artificial Sequence; identical to SEQ ID NO: 94633
  Description of Artificial Sequence: Synthetic coding sequence

SEQ ID NO: 94641 - DNA, 6474 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94642 - DNA, 6417 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgcccccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcctggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94643 - DNA, 6474 bp, Artificial Sequence; identical to SEQ ID NO: 94633
  Description of Artificial Sequence: Synthetic coding sequence

SEQ ID NO: 94644 - DNA, 6474 bp, Artificial Sequence; identical to SEQ ID NO: 94636
  Description of Artificial Sequence: Synthetic coding sequence

SEQ ID NO: 94645 - DNA, 6474 bp, Artificial Sequence; identical to SEQ ID NO: 94641
  Description of Artificial Sequence: Synthetic coding sequence

SEQ ID NO: 94646 - DNA, 6474 bp, Artificial Sequence; identical to SEQ ID NO: 94635
  Description of Artificial Sequence: Synthetic coding sequence

SEQ ID NO: 94647 - DNA, 6450 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94648 - DNA, 1650 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgccagcgaggtgcccctgatggaggacagcagaggccagcagagagacccccccagaggcctggaggccccccacccctag

SEQ ID NO: 94649 - DNA, 6417 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgcccccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagcacaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcgtgaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgccccccccagcctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94650 - DNA, 6450 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagcacaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcgtgaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgccccccccagcctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94651 - DNA, 1650 bp, Artificial Sequence; identical to SEQ ID NO: 94648
  Description of Artificial Sequence: Synthetic coding sequence

SEQ ID NO: 94652 - DNA, 1650 bp, Artificial Sequence; identical to SEQ ID NO: 94648
  Description of Artificial Sequence: Synthetic coding sequence

SEQ ID NO: 94653 - DNA, 4149 bp, Artificial Sequence
  Description of Artificial Sequence: Synthetic coding sequence
atgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagcacaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgccccccccagcctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94654 - DNA, 6417 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagcccctggagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgcccccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94655 - DNA, 6417 bp, Artificial Sequence; identical to SEQ ID NO: 94649
  Description of Artificial Sequence: Synthetic coding sequence

SEQ ID NO: 94656 - DNA, 6417 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgcccccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaccgagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94657 - DNA, 6417 bp, Artificial Sequence; identical to SEQ ID NO: 94649
  Description of Artificial Sequence: Synthetic coding sequence

SEQ ID NO: 94658 - DNA, 6417 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgcccccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94659 - DNA, 4149 bp, Artificial Sequence
  Description of Artificial Sequence: Synthetic coding sequence
atgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggcctgccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94660 - DNA, 6450 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagccccccgagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94661 - DNA, 6450 bp, Artificial Sequence
  Description of Artificial Sequence: Synthetic coding sequence
atgagcgacagaagcggccccaccgccaagggcaaggacggcaagaagtacagcagcctgaacctgttcgacacctacaagggcaagagcctggagatccagaagcccgccgtggcccccagacacggcctgcagagcctgggcaaggtggccatcgccagaagaatgcccccccccgccaacctgcccagcctgaaggccgagaacaagggcaacgaccccaacgtgagcctggtgcccaaggacggcaccggctgggccagcaagcaggagcagagcgaccccaagagcagcgacgccagcaccgcccagcccctggagagccagcccctgcccgccagccagacccccgccagcaaccagcccaagagaccccccgccgcccccgagaacacccccctggtgcccagcggcgtgaagagctgggcccaggccagcgtgacccacggcgcccacggcgacggcggcagagccagcagcctgctgagcagattcagcagagaggagttccccaccctgcaggccgccggcgaccaggacaaggccgccaaggagagagagagcgccgagcagagcagcggccccggccccagcctgagaccccagaacagcaccacctggagagacggcggcggcagaggccccgacgagctggagggccccgacagcaagctgcaccacggccacgaccccagaggcggcctgcagcccagcggccccccccagttccccccctacagaggcatgatgccccccttcatgtaccccccctacctgcccttcccccccccctacggcccccagggcccctacagataccccacccccgacggccccagcagattccccagagtggccggccccagaggcagcggcccccccatgagactggtggagcccgtgggcagacccagcatcctgaaggaggacaacctgaaggagttcgaccagctggaccaggagaacgacgacggctgggccggcgcccacgaggaggtggactacaccgagaagctgaagttcagcgacgaggaggacggcagagacagcgacgaggagggcgccgagggccacagagacagccagagcgccagcggcgaggagagaccccccgaggccgacggcaagaagggcaacagccccaacagcgagccccccacccccaagaccgcctgggccgagaccagcagaccccccgagaccgagcccggcccccccgcccccaagccccccctgccccccccccacagaggccccgccggcaactggggcccccccggcgactaccccgacagaggcggccccccctgcaagccccccgcccccgaggacgaggacgaggcctggagacagagaagaaagcagagcagcagcgagatcagcctggccgtggagagagccagaagaagaagagaggaggaggagagaagaatgcaggaggagagaagagccgcctgcgccgagaagctgaagagactggacgagaagttcggcgcccccgacaagagactgaaggccgagcccgccgccccccccgccgcccccagcacccccgcccccccccccgccgtgcccaaggagctgcccgccccccccgcccccccccccgccagcgcccccacccccgagaaggagcccgaggagcccgcccaggccccccccgcccagagcacccccacccccggcgtggccgccgcccccaccctggtgagcggcggcggcagcaccagcagcaccagcagcggcagcttcgaggccagccccgtggagccccagctgcccagcaaggagggccccgagccccccgaggaggtgcccccccccaccaccccccccgtgcccaaggtggagcccaagggcgacggcatcggccccaccagacagccccccagccagggcctgggctaccccaagtaccagaagagcctgccccccagattccagagacagcagcaggagcagctgctgaagcagcagcagcagcaccagtggcagcagcaccagcagggcagcgccccccccacccccgtgccccccagccccccccagcccgtgaccctgggcgccgtgcccgccccccaggcccccccccccccccccaaggccctgtaccccggcgccctgggcagacccccccccatgccccccatgaacttcgaccccagatggatgatgatccccccctacgtggaccccagactgctgcagggcagaccccccctggacttctacccccccggcgtgcaccccagcggcctggtgcccagagagagaagcgacagcggcggcagcagcagcgagcccttcgacagacacgcccccgccatgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccgccggcaacagcgccgtgaccgagagcttcgaggagatgatgggcgtggaggtgggccagggcgaccagaccaccctgctgctgcccgaggccgccctgcccgccagacacggcgccagagtgcagagcatgagaaagagccccagcggcgccggcagcggcgcccagaagcaggccgccagacccatgagagtgatctggctgctgcagaccagaagactgccccaccccagaagagagcacagccccagaagcagaagccccaccaccagaagccccaccttccccgcccccgccagattcacccccggcgtgggcgagagcagcctgcccgagggcatcagccccggccccagaagaagagagcccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggccacggcctgagcatcaccagcaagcagtggagaagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94662 - DNA, 4149 bp, Artificial Sequence
  Description of Artificial Sequence: Synthetic coding sequence
atgctgagagagagaggcaccccccccgtggaccccaagctggcctgggtgggcgacgtgttcaccgccacccccgccgagcccagacccctgaccagccccctgagacaggccgccgacgaggacgacaagggcatgagaagcgagaccccccccgtgccccccccccccccctacctggccagctaccccggcttccccgagaacggcgcccccggcccccccatcagcagattccccctggaggagcccggccccagacccctgccctggccccccggcagcgacgaggtggccaagatccagacccccccccccaagaaggagccccccaaggaggagaccgcccagctgaccggccccgaggccggcagaaagcccgccagaggcgtgggcagcggcggccagggcccccccccccccagaagagagagcagaaccgagaccagatggggccccagacccggcagcagcagaagaggcatcccccccgaggagcccggcgccccccccagaagagccggccccatcaagaagccccccccccccaccaaggtggaggagctgccccccaagcccctggagcagggcgacgagacccccaagccccccaagcccgaccccctgaagatcaccaagggcaagctgggcggccccaaggagaccccccccaacggcaacctgagccccgcccccagactgagaagagactacagctacgagagagtgggccccaccagctgcagaggcagaggcagaggcgagtacttcgccagaggcagaggcttcagaggcacctacggcggcagaggcagaggcgccagaagcagagagttcagaagctacagagagttcagaggcgacgacggcagaggcggcggcaccggcggccccaaccacccccccgcccccagaggcagaaccgccagcgagaccagaagcgagggcagcgagtacgaggagatccccaagagaagaagacagagaggcagcgagaccggcagcgagacccacgagagcgacctggcccccagcgacaaggaggcccccacccccaaggagggcaccctgacccaggtgcccctggccccccccccccccggcgccccccccagccccgcccccgccagattcaccgccagaggcggcagagtgttcacccccagaggcgtgcccagcagaagaggcagaggcggcggcagaccccccccccaggtgtgccccggctggagcccccccgccaagagcctggcccccaagaagccccccaccggccccctgccccccagcaaggagcccctgaaggagaagctgatccccggccccctgagccccgtggccagaggcggcagcaacggcggcagcaacgtgggcatggaggacggcgagagacccagaagaagaagacacggcagagcccagcagcaggacaagccccccagattcagaagactgaagcaggagagagagaacgccgccagaggcagcgagggcaagcccagcctgaccctgcccgccagcgcccccggccccgaggaggccctgaccaccgtgaccgtggcccccgcccccagaagagccgccgccaagagccccgacctgagcaaccagaacagcgaccaggccaacgaggagtgggagaccgccagcgagagcagcgacttcaccagcgagagaagaggcgacaaggaggcccccccccccgtgctgctgacccccaaggccgtgggcacccccggcggcggcggcggcggcgccgtgcccggcatcagcgccatgagcagaggcgacctgagccagagagccaaggacctgagcaagagaagcttcagcagccagagacccggcatggagagacagaacagaagacccggccccggcggcaaggccggcagcagcggcagcagcagcggcggcggcggcggcggccccggcggcagaaccggccccggcagaggcgacaagagaagctggcccagccccaagaacagaagcagaccccccgaggagagaccccccggcctgcccctgcccccccccccccccagcagcagcgccgtgttcagactggaccaggtgatccacagcaaccccgccggcatccagcaggccctggcccagctgagcagcagacagggcagcgtgaccgcccccggcggccaccccagacacaagcccggccccccccaggccccccagggccccagccccagaccccccaccagatacgagccccagagagtgaacagcggcctgagcagcgacccccacttcgaggagcccggccccatggtgagaggcgtgggcggcacccccagagacagcgccggcgtgagccccttcccccccaagagaagagagagaccccccagaaagcccgagctgctgcaggaggagagcctgccccccccccacagcagcggcttcctgggcagcaagcccgagggccccggcccccaggccgagagcagagacaccggcaccgaggccctgaccccccacatctggaacagactgcacaccgccaccagcagaaagagctacagacccagcagcatggagccctggatggagcccctgagccccttcgaggacgtggccggcaccgagatgagccagagcgacagcggcgtggacctgagcggcgacagccaggtgagcagcggcccctgcagccagagaagcagccccgacggcggcctgaagggcgccgccgagggcccccccaagagacccggcggcagcagccccctgaacgccgtgccctgcgagggcccccccggcagcgagccccccagaagacccccccccgccccccacgacggcgacagaaaggagctgcccagagagcagcccctgccccccggccccatcggcaccgagagaagccagagaaccgacagaggcaccgagcccggccccatcagacccagccacagacccggcccccccgtgcagttcggcaccagcgacaaggacagcgacctgagactggtggtgggcgacagcctgaaggccgagaaggagctgaccgccagcgtgaccgaggccatccccgtgagcagagactgggagctgctgcccagcgccgccgccagcgccgagccccagagcaagaacctggacagcggccactgcgtgcccgagcccagcagcagcggccagagactgtaccccgaggtgttctacggcagcgccggccccagcagcagccagatcagcggcggcgccatggacagccagctgcaccccaacagcggcggcttcagacccggcacccccagcctgcacccctacagaagccagcccctgtacctgccccccggccccgccccccccagcgccctgctgagcggcgtggccctgaagggccagttcctggacttcagcaccatgcaggccaccgagctgggcaagctgcccgccggcggcgtgctgtaccccccccccagcttcctgtacagccccgccttctgccccagccccctgcccgacaccagcctgctgcaggtgagacaggacctgcccagccccagcgacttctacagcacccccctgcagcccggcggccagagcggcttcctgcccagcggcgcccccgcccagcagatgctgctgcccatggtggacagccagctgcccgtggtgaacttcggcagcctgccccccgcccccccccccgcccccccccccctgagcctgctgcccgtgggccccgccctgcagccccccagcctggccgtgagacccccccccgcccccgccaccagagtgctgcccagccccgccagacccttccccgccagcctgggcagagccgagctgcaccccgtggagctgaagcccttccaggactaccagaagctgagcagcaacctgggcggccccggcagcagcagaaccccccccaccggcagaagcttcagcggcctgaacagcagactgaaggccacccccagcacctacagcggcgtgttcagaacccagagagtggacctgtaccagcaggccagcccccccgacgccctgagatggatccccaagccctgggagagaaccggccccccccccagagagggccccagcagaagagccgaggagcccggcagcagaggcgacaaggagcccggcctgcccccccccagatag

SEQ ID NO: 94663 - DNA, 4149 bp, Artificial Sequence; identical to SEQ ID NO: 94662
  Description of Artificial Sequence: Synthetic coding sequence

SEQ ID NO: 94664 - DNA, 6450 bp, Artificial Sequence; identical to SEQ ID NO: 94650
  Description of Artificial Sequence: Synthetic coding sequence

SEQ ID NO: 94665 - DNA, 4149 bp, Artificial Sequence; identical to SEQ ID NO: 94653
  Description of Artificial Sequence: Synthetic coding sequence

SEQ ID NO: 94666 - DNA, 6450 bp, Artificial Sequence; identical to SEQ ID NO: 94650
  Description of Artificial Sequence: Synthetic coding sequence

SEQ ID NO: 94667 - DNA, 1650 bp, Artificial Sequence; identical to SEQ ID NO: 94648
  Description of Artificial Sequence: Synthetic coding sequence

SEQ ID NO: 94668 - DNA, 1650 bp, Artificial Sequence; identical to SEQ ID NO: 94648
  Description of Artificial Sequence: Synthetic coding sequence

SEQ ID NO: 94669 - DNA, 4149 bp, Artificial Sequence; identical to SEQ ID NO: 94653
  Description of Artificial Sequence: Synthetic coding sequence

SEQ ID NO: 94670 - DNA, 984 bp, Artificial Sequence
  Description of Artificial Sequence: Synthetic coding sequence
atgaccgtggtgagcgtgccccagagagagcccctggtgctgggcggcagactggcccccctgggcttcagcagcagaggctacttcggcgccctgcccatggtgaccaccgcccccccccccctgcccagaatccccgaccccagagccctgccccccaccctgttcctgccccacttcctgggcggcgacggcccctgcctgaccccccagcccagagcccccgccgccctgcccaacagaagcctggccgtggccggcggcacccccagagccgcccccaagaagagaagaaagaagaaggtgagagccagccccgccggccagctgcccagcagattccaccagtaccagcagcacagacccagcctggagggcggcagaagccccgccaccggccccagcggcgcccaggaggtgcccggccccgccgccgccctggcccccagccccgccgccgccgccggcaccgagggcgccagccccgacctggcccccctgagacccgccgcccccggccagacccccctgagaaaggaggtgctgaagagcaagatgggcaagagcgagaagatcgccctgccccacggccagctggtgcacggcatccacctgtacgagcagcccaagatcaacagacagaagagcaagtacaacctgcccctgaccaagatcaccagcgccaagagaaacgagaacaacttctggcaggacagcgtgagcagcgacagaatccagaagcaggagaagaagcccttcaagaacaccgagaacatcaagaacagccacctgaagaagagcgccttcctgaccgaggtgagccagaaggagaactacgccggcgccaagttcagcgacccccccagccccagcgtgctgcccaagccccccagccactggatgggcagcaccgtggagaacagcaaccagaacagagagctgatggccgtgcacctgaagaccctgctgaaggtgcagacctag

SEQ ID NO: 94671 - DNA, 429 bp, Artificial Sequence
  Description of Artificial Sequence: Synthetic coding sequence
atgggcaagagcgagaagatcgccctgccccacggccagctggtgcacggcatccacctgtacgagcagcccaagatcaacagacagaagagcaagtacaacctgcccctgaccaagatcaccagcgccaagagaaacgagaacaacttctggcaggacagcgtgagcagcgacagaatccagaagcaggagaagaagcccttcaagaacaccgagaacatcaagaacagccacctgaagaagagcgccttcctgaccgaggtgagccagaaggagaactacgccggcgccaagttcagcgacccccccagccccagcgtgctgcccaagccccccagccactggatgggcagcaccgtggagaacagcaaccagaacagagagctgatggccgtgcacctgaagaccctgctgaaggtgcagacctag

SEQ ID NO: 94672 - DNA, 429 bp, Artificial Sequence; identical to SEQ ID NO: 94671
  Description of Artificial Sequence: Synthetic coding sequence

SEQ ID NO: 94673 - DNA, 420 bp, Artificial Sequence
  Description of Artificial Sequence: Synthetic coding sequence
atgggcggcggcgagagatacaacatccccgccccccagagcagaaacgtgagcaagaaccagcagcagctgaacagacagaagaccaaggagcagaacagccagatgaagatcgtgcacaagaagaaggagagaggccacggctacaacagcagcgccgccgcctggcaggccatgcagaacggcggcaagaacaagaacttccccaacaaccagagctggaacagcagcctgagcggccccagactgctgttcaagagccaggccaaccagaactacgccggcgccaagttcagcgagccccccagccccagcgtgctgcccaagccccccagccactgggtgcccgtgagcttcaaccccagcgacaaggagatcatgaccttccagctgaagaccctgctgaaggtgcaggtgtag

SEQ ID NO: 94674 - DNA, 420 bp, Artificial Sequence; identical to SEQ ID NO: 94673
  Description of Artificial Sequence: Synthetic coding sequence

SEQ ID NO: 94675 - DNA, 597 bp, Artificial Sequence
  Description of Artificial Sequence: Synthetic coding sequence
atgctgctgatcctgctgagcgtggccctgctggccctgagcagcgcccagaacctgaacgaggacgtgagccaggaggagagccccagcctgatcgccggcaacccccagggccccagcccccagggcggcaacaagccccagggccccccccccccccccggcaagccccagggcccccccccccagggcggcaacaagccccagggcccccccccccccggcaagccccagggcccccccccccagggcgacaagagcagaagccccagaagcccccccggcaagccccagggcccccccccccagggcggcaagccccagggcccccccccccagggcggcaacaagccccagggcccccccccccccggcaagccccagggcccccccgcccagggcggcagcaagagccagagcgccagaagcccccccggcaagccccagggccccccccagcaggagggcaacaacccccagggcccccccccccccgccggcggcaacccccagcagccccaggccccccccgccggccagccccagggcccccccagacccccccagggcggcagacccagcagacccccccagtag

SEQ ID NO: 94676 - DNA, 537 bp, Artificial Sequence
  Description of Artificial Sequence: Synthetic coding sequence
atgctgctgatcctgctgagcgtggccctgctggccctgagcagcgcccagaacctgaacgaggacgtgagccaggaggagagccccagcctgatcgccggcaacccccagggccccagcccccagggcggcaacaagccccagggccccccccccccccccggcaagccccagggcccccccccccagggcggcaacaagccccagggcccccccccccccggcaagccccagggcccccccccccagggcgacaagagcagaagccccagaagcccccccggcaagccccagggcccccccccccagggcggcaagccccagggcccccccgcccagggcggcagcaagagccagagcgccagaagcccccccggcaagccccagggccccccccagcaggagggcaacaacccccagggcccccccccccccgccggcggcaacccccagcagccccaggccccccccgccggccagccccagggcccccccagacccccccagggcggcagacccagcagacccccccagtag

SEQ ID NO: 94677 - DNA, 597 bp, Artificial Sequence; identical to SEQ ID NO: 94675
  Description of Artificial Sequence: Synthetic coding sequence

SEQ ID NO: 94678 - DNA, 1251 bp, Artificial Sequence
  Description of Artificial Sequence: Synthetic coding sequence
atgctgctgatcctgctgagcgtggccctgctggccctgagcagcgcccagaacctgaacgaggacgtgagccaggaggagagccccagcctgatcgccggcaacccccagggcgcccccccccagggcggcaacaagccccagggcccccccagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaagagcagaagccccagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagagcagaagcagcagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagagccagagcgccagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcagcaagagcagaagcagcagaagcccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcagcaagagcagaagcgccagaagcccccccggcaagccccagggccccccccagcaggagggcaacaacccccagggcccccccccccccgccggcggcaacccccagcagccccaggccccccccgccggccagccccagggcccccccagacccccccagggcggcagacccagcagacccccccagtag

SEQ ID NO: 94679 - DNA, 744 bp, Artificial Sequence
  Description of Artificial Sequence: Synthetic coding sequence
atgctgctgatcctgctgagcgtggccctgctggccctgagcagcgccgagagcagcagcgaggacgtgagccaggaggagagcctgttcctgatcagcggcaagcccgagggcagaagaccccagggcggcaaccagccccagagacccccccccccccccggcaagccccagggcccccccccccagggcggcaaccagagccagggccccccccccccccccggcaagcccgagggcagacccccccagggcggcaaccagagccagggcccccccccccaccccggcaagcccgagagaccccccccccagggcggcaaccagagccagggcaccccccccccccccggcaagcccgagagaccccccccccagggcggcaaccagagccacagacccccccccccccccggcaagcccgagagaccccccccccagggcggcaaccagagccagggcccccccccccaccccggcaagcccgagggcccccccccccaggagggcaacaagagcagaagcgccagaagcccccccggcaagccccagggccccccccagcaggagggcaacaagccccagggcccccccccccccggcaagccccagggccccccccccgccggcggcaacccccagcagccccaggccccccccgccggcaagccccagggcccccccccccccccccagggcggcagaccccccagacccgcccagggccagcagcccccccagtag

SEQ ID NO: 94680 - DNA, 744 bp, Artificial Sequence; identical to SEQ ID NO: 94679
  Description of Artificial Sequence: Synthetic coding sequence

SEQ ID NO: 94681 - DNA, 537 bp, Artificial Sequence
  Description of Artificial Sequence: Synthetic coding sequence
atgctgctgatcctgctgagcgtggccctgctggccctgagcagcgccgagagcagcagcgaggacgtgagccaggaggagagcctgttcctgatcagcggcaagcccgagggcagaagaccccagggcggcaaccagccccagagacccccccccccccccggcaagccccagggcccccccccccagggcggcaaccagagccagggccccccccccccccccggcaagcccgagggcagacccccccagggcggcaaccagagccagggcccccccccccaccccggcaagcccgagagaccccccccccagggcggcaaccagagccagggcaagccccagggccccccccagcaggagggcaacaagccccagggcccccccccccccggcaagccccagggccccccccccgccggcggcaacccccagcagccccaggccccccccgccggcaagccccagggcccccccccccccccccagggcggcagaccccccagacccgcccagggccagcagcccccccagtag

SEQ ID NO: 94682 - DNA, 501 bp, Artificial Sequence
  Description of Artificial Sequence: Synthetic coding sequence
atgctgctgatcctgctgagcgtggccctgctggccttcagcagcgcccaggacctgaacgaggacgtgagccaggaggacgtgcccctggtgatcagcgacggcggcgacagcgagcagttcctggacgaggagagacagggcccccccctgggcggccagcagagccagcccagcgccggcgacggcaaccaggacgacggcccccagcagggccccccccagcagggcggccagcagcagcagggccccccccccccccagggcaagccccagggccccccccagcagggcggccaccccccccccccccagggcagaccccagggccccccccagcagggcggccaccccagaccccccagaggcagaccccagggccccccccagcagggcggccaccagcagggcccccccccccccccccccggcaagccccagggcccccccccccagggcggcagaccccagggccccccccagggccagagcccccagtag

SEQ ID NO: 94683 - DNA, 291 bp, Artificial Sequence
  Description of Artificial Sequence: Synthetic coding sequence
atgctgctgatcctgctgagcgtggccctgctggccttcagcagcgcccaggacctggacgaggacgtgagccaggaggacgtgcccctggtgatcagcgacggcggcgacagcgagcagttcatcgacgaggagggccacaaggaccaccccaacagagaggccatcagcaaggtgctgccccacctgctgctggagagccccagagaccacctgcccaagggcgccgcccacaaggacctgcacagaggcagcctgctgagcaacctgggcttcaacgacagaaagtag

SEQ ID NO: 94684 - DNA, 501 bp, Artificial Sequence
  Description of Artificial Sequence: Synthetic coding sequence
atgctgctgatcctgctgagcgtggccctgctggccttcagcagcgcccaggacctggacgaggacgtgagccaggaggacgtgcccctggtgatcagcgacggcggcgacagcgagcagttcatcgacgaggagagacagggcccccccctgggcggccagcagagccagcccagcgccggcgacggcaaccagaacgacggcccccagcagggccccccccagcagggcggccagcagcagcagggccccccccccccccagggcaagccccagggccccccccagcagggcggccaccccccccccccccagggcagaccccagggccccccccagcagggcggccaccccagaccccccagaggcagaccccagggccccccccagcagggcggccaccagcagggcccccccccccccccccccggcaagccccagggcccccccccccagggcggcagaccccagggccccccccagggccagagcccccagtag

SEQ ID NO: 94685 - DNA, 501 bp, Artificial Sequence; identical to SEQ ID NO: 94684
  Description of Artificial Sequence: Synthetic coding sequence

SEQ ID NO: 94686 - DNA, 900 bp, Artificial Sequence
  Description of Artificial Sequence: Synthetic coding sequence
atggccgccagcagcagcgagatcagcgagatgaagggcgtggaggagagccccaaggtgcccggcgagggccccggccacagcgaggccgagaccggccccccccaggtgctggccggcgtgcccgaccagcccgaggccccccagcccggccccaacaccaccgccgcccccgtggacagcggccccaaggccggcctggcccccgagaccaccgagacccccgccggcgccagcgagaccgcccaggccaccgacctgagcctgagccccggcggcgagagcaaggccaactgcagccccgaggacccctgccaggagaccgtgagcaagcccgaggtgagcaaggaggccaccgccgaccagggcagcagactggagagcgccgccccccccgagcccgcccccgagcccgccccccagcccgaccccagacccgacagccagcccacccccaagcccgccctgcagcccgagctgcccacccaggaggaccccacccccgagatcctgagcgagagcgtgggcgagaagcaggagaacggcgccgtggtgcccctgcaggccggcgacggcgaggagggccccgcccccgagccccacagcccccccagcaagaagagcccccccgccaacggcgccccccccagagtgctgcagcagctggtggaggaggacagaatgagaagagcccacagcggccaccccggcagccccagaggcagcctgagcagacaccccagcagccagctggccggccccggcgtggagggcggcgagggcacccagaagcccagagactacatcatcctggccatcctgagctgcttctgccccatgtggcccgtgaacatcgtggccttcgcctacgccgtgatggtgagccccatgggcccctag

SEQ ID NO: 94687 - DNA, 1023 bp, Artificial Sequence
  Description of Artificial Sequence: Synthetic coding sequence
atggccgccagcagcagcgagatcagcgagatgaagggcgtggaggagagccccaaggtgcccggcgagggccccggccacagcgaggccgagaccggccccccccaggtgctggccggcgtgcccgaccagcccgaggccccccagcccggccccaacaccaccgccgcccccgtggacagcggccccaaggccggcctggcccccgagaccaccgagacccccgccggcgccagcgagaccgcccaggccaccgacctgagcctgagccccggcggcgagagcaaggccaactgcagccccgaggacccctgccaggagaccgtgagcaagcccgaggtgagcaaggaggccaccgccgaccagggcagcagactggagagcgccgccccccccgagcccgcccccgagcccgccccccagcccgaccccagacccgacagccagcccacccccaagcccgccctgcagcccgagctgcccacccaggaggaccccacccccgagatcctgagcgagagcgtgggcgagaagcaggagaacggcgccgtggtgcccctgcaggccggcgacggcgaggagggccccgcccccgagccccacagcccccccagcaagaagagcccccccgccaacggcgccccccccagagtgctgcagcagctggtggaggaggacagaatgagaagagcccacagcggccaccccggcagccccagaggcagcctgagcagacaccccagcagccagctggccggccccggcgtggagggcggcgagggcacccagaagcccagagactacatcatcctggccatcctgagctgcttctgccccatgtggcccgtgaacatcgtggccttcgcctacgccgtgatgagcagaaacagcctgcagcagggcgacgtggacggcgcccagagactgggcagagtggccaagctgctgagcatcgtggccctggtgggcggcgtgctgatcatcatcgccagctgcgtgatcaacctgggcgtgtacaagtag

SEQ ID NO: 94688 - DNA, 1191 bp, Artificial Sequence
  Description of Artificial Sequence: Synthetic coding sequence
atgccccagctgcagttcaaggacgccttctggtgcagagacttcaccgcccacaccggctacgaggtgctgctgcagagactgctggacggcagaaagatgtgcaaggacatggaggagctgctgagacagagagcccaggccgaggagagatacggcaaggagctggtgcagatcgccagaaaggccggcggccagaccgagatcaacagcctgagagccagcttcgacagcctgaagcagcagatggagaacgtgggcagcagccacatccagctggccctgaccctgagagaggagctgagaagcctggaggagttcagagagagacagaaggagcagagaaagaagtacgaggccgtgatggacagagtgcagaagagcaagctgagcctgtacaagaaggccatggagagcaagaagacctacgagcagaagtgcagagacgccgacgacgccgagcaggccttcgagagaatcagcgccaacggccaccagaagcaggtggagaagagccagaacaaggccagacagtgcaaggacagcgccaccgaggccgagagagtgtacagacagagcatcgcccagctggagaaggtgagagccgagtgggagcaggagcacagaaccacctgcgaggccttccagctgcaggagttcgacagactgaccatcctgagaaacgccctgtgggtgcacagcaaccagctgagcatgcagtgcgtgaaggacgacgagctgtacgaggaggtgagactgaccctggagggctgcagcatcgacgccgacatcgacagcttcatccaggccaagagcaccggcaccgagccccccggcgaggtgagactggccgacagcgccgccagcagattcagcggcctgctgcacggcagccccaagaccaccagcctggccgccagcgccgccagcaccgagaccctgacccccacccccgagagaaacgagggcgtgtacaccgccatcgccgtgcaggagatccagggcaaccccgccagccccgcccaggagtacagagccctgtacgactacaccgcccagaaccccgacgagctggacctgagcgccggcgacatcctggaggtgatcctggagggcgaggacggctggtggaccgtggagagaaacggccagagaggcttcgtgcccggcagctacctggagaagctgtag

SEQ ID NO: 94689 - DNA, 1251 bp, Artificial Sequence
  Description of Artificial Sequence: Synthetic coding sequence
atgatgccccagctgcagttcaaggacgccttctggtgcagagacttcaccgcccacaccggctacgaggtgctgctgcagagactgctggacggcagaaagatgtgcaaggacatggaggagctgctgagacagagagcccaggccgaggagagatacggcaaggagctggtgcagatcgccagaaaggccggcggccagaccgagatcaacagcctgagagccagcttcgacagcctgaagcagcagatggagaacgtgggcagcagccacatccagctggccctgaccctgagagaggagctgagaagcctggaggagttcagagagagacagaaggagcagagaaagaagtacgaggccgtgatggacagagtgcagaagagcaagctgagcctgtacaagaaggccatggagagcaagaagacctacgagcagaagtgcagagacgccgacgacgccgagcaggccttcgagagaatcagcgccaacggccaccagaagcaggtggagaagagccagaacaaggccagacagtgcaaggacagcgccaccgaggccgagagagtgtacagacagagcatcgcccagctggagaaggtgagagccgagtgggagcaggagcacagaaccacctgcgaggccttccagctgcaggagttcgacagactgaccatcctgagaaacgccctgtgggtgcacagcaaccagctgagcatgcagtgcgtgaaggacgacgagctgtacgaggaggtgagactgaccctggagggctgcagcatcgacgccgacatcgacagcttcatccaggccaagagcaccggcaccgagccccccgcccccgtgccctaccagaactactacgacagagaggtgacccccctgaccagcagccccggcatccagcccagctgcggcatgatcaagagattcagcggcctgctgcacggcagccccaagaccaccagcctggccgccagcgccgccagcaccgagaccctgacccccacccccgagagaaacgagggcgtgtacaccgccatcgccgtgcaggagatccagggcaaccccgccagccccgcccaggagtacagagccctgtacgactacaccgcccagaaccccgacgagctggacctgagcgccggcgacatcctggaggtgatcctggagggcgaggacggctggtggaccgtggagagaaacggccagagaggcttcgtgcccggcagctacctggagaagctgtag

SEQ ID NO: 94690 - DNA, 1605 bp, Artificial Sequence
  Description of Artificial Sequence: Synthetic coding sequence
atgatctggtacatcctgatcatcggcatcctgctgccccagagcctggcccaccccggcttcttcaccagcatcggccagatgaccgacctgatccacaccgagaaggacctggtgaccagcctgaaggactacatcaaggccgaggaggacaagctggagcagatcaagaagtgggccgagaagctggacagactgaccagcaccgccaccaaggaccccgagggcttcgtgggccaccccgtgaacgccttcaagctgatgaagagactgaacaccgagtggagcgagctggagaacctggtgctgaaggacatgagcgacggcttcatcagcaacctgaccatccagagacagtacttccccaacgacgaggaccaggtgggcgccgccaaggccctgctgagactgcaggacacctacaacctggacaccgacaccatcagcaagggcaacctgcccggcgtgaagcacaagagcttcctgaccgccgaggactgcttcgagctgggcaaggtggcctacaccgaggccgactactaccacaccgagctgtggatggagcaggccctgagacagctggacgagggcgagatcagcaccatcgacaaggtgagcgtgctggactacctgagctacgccgtgtaccagcagggcgacctggacaaggccctgctgctgaccaagaagctgctggagctggaccccgagcaccagagagccaacggcaacctgaagtacttcgagtacatcatggccaaggagaaggacgtgaacaagagcgccagcgacgaccagagcgaccagaagaccacccccaagaagaagggcgtggccgtggactacctgcccgagagacagaagtacgagatgctgtgcagaggcgagggcatcaagatgacccccagaagacagaagaagctgttctgcagataccacgacggcaacagaaaccccaagttcatcctggcccccgccaagcaggaggacgagtgggacaagcccagaatcatcagattccacgacatcatcagcgacgccgagatcgagatcgtgaaggacctggccaagcccagactgagcagagccaccgtgcacgaccccgagaccggcaagctgaccaccgcccagtacagagtgagcaagagcgcctggctgagcggctacgagaaccccgtggtgagcagaatcaacatgagaatccaggacctgaccggcctggacgtgagcaccgccgaggagctgcaggtggccaactacggcgtgggcggccagtacgagccccacttcgacttcgccagaaaggacgagcccgacgccttcaaggagctgggcaccggcaacagaatcgccacctggctgttctacatgagcgacgtgagcgccggcggcgccaccgtgttccccgaggtgggcgccagcgtgtggcccaagaagggcaccgccgtgttctggtacaacctgttcgccagcggcgagggcgactacagcaccagacacgccgcctgccccgtgctggtgggcaacaagtgggtgagcaacaagtggctgcacgagagaggccaggagttcagaagaccctgcaccctgagcgagctggagtag

SEQ ID NO: 94691 - DNA, 1605 bp, Artificial Sequence
  Description of Artificial Sequence: Synthetic coding sequence
atgatctggtacatcctgatcatcggcatcctgctgccccagagcctggcccaccccggcttcttcaccagcatcggccagatgaccgacctgatccacaccgagaaggacctggtgaccagcctgaaggactacatcaaggccgaggaggacaagctggagcagatcaagaagtgggccgagaagctggacagactgaccagcaccgccaccaaggaccccgagggcttcgtgggccaccccgtgaacgccttcaagctgatgaagagactgaacaccgagtggagcgagctggagaacctggtgctgaaggacatgagcgacggcttcatcagcaacctgaccatccagagacagtacttccccaacgacgaggaccaggtgggcgccgccaaggccctgctgagactgcaggacacctacaacctggacaccgacaccatcagcaagggcaacctgcccggcgtgaagcacaagagcttcctgaccgccgaggactgcttcgagctgggcaaggtggcctacaccgaggccgactactaccacaccgagctgtggatggagcaggccctgagacagctggacgagggcgagatcagcaccatcgacaaggtgagcgtgctggactacctgagctacgccgtgtaccagcagggcgacctggacaaggccctgctgctgaccaagaagctgctggagctggaccccgagcaccagagagccaacggcaacctgaagtacttcgagtacatcatggccaaggagaaggacgtgaacaagagcgccagcgacgaccagagcgaccagaagaccacccccaagaagaagggcgtggccgtggactacctgcccgagagacagaagtacgagatgctgtgcagaggcgagggcatcaagatgacccccagaagacagaagaagctgttctgcagataccacgacggcaacagaaaccccaagttcatcctggcccccgccaagcaggaggacgagtgggacaagcccagaatcatcagattccacgacatcatcagcgacgccgagatcgagatcgtgaaggacctggccaagcccagactgagaagagccaccatcagcaaccccatcaccggcgacctggagaccgtgcactacagaatcagcaagagcgcctggctgagcggctacgagaaccccgtggtgagcagaatcaacatgagaatccaggacctgaccggcctggacgtgagcaccgccgaggagctgcaggtggccaactacggcgtgggcggccagtacgagccccacttcgacttcgccagaaaggacgagcccgacgccttcaaggagctgggcaccggcaacagaatcgccacctggctgttctacatgagcgacgtgagcgccggcggcgccaccgtgttccccgaggtgggcgccagcgtgtggcccaagaagggcaccgccgtgttctggtacaacctgttcgccagcggcgagggcgactacagcaccagacacgccgcctgccccgtgctggtgggcaacaagtgggtgagcaacaagtggctgcacgagagaggccaggagttcagaagaccctgcaccctgagcgagctggagtag

SEQ ID NO: 94692 - DNA, 1605 bp, Artificial Sequence; identical to SEQ ID NO: 94690
  Description of Artificial Sequence: Synthetic coding sequence

SEQ ID NO: 94693 - DNA, 1605 bp, Artificial Sequence; identical to SEQ ID NO: 94691
  Description of Artificial Sequence: Synthetic coding sequence

SEQ ID NO: 94694 - DNA, 1605 bp, Artificial Sequence; identical to SEQ ID NO: 94691
  Description of Artificial Sequence: Synthetic coding sequence

SEQ ID NO: 94695 - DNA, 1551 bp, Artificial Sequence
  Description of Artificial Sequence: Synthetic coding sequence
atgatctggtacatcctgatcatcggcatcctgctgccccagagcctggcccaccccggcttcttcaccagcatcggccagatgaccgacctgatccacaccgagaaggacctggtgaccagcctgaaggactacatcaaggccgaggaggacaagctggagcagatcaagaagtgggccgagaagctggacagactgaccagcaccgccaccaaggaccccgagggcttcgtgggccaccccgtgaacgccttcaagctgatgaagagactgaacaccgagtggagcgagctggagaacctggtgctgaaggacatgagcgacggcttcatcagcaacctgaccatccagagacagtacttccccaacgacgaggaccaggtgggcgccgccaaggccctgctgagactgcaggacacctacaacctggacaccgacaccatcagcaagggcaacctgcccggcgtgaagcacaagagcttcctgaccgccgaggactgcttcgagctgggcaaggtggcctacaccgaggccgactactaccacaccgagctgtggatggagcaggccctgagacagctggacgagggcgagatcagcaccatcgacaaggtgagcgtgctggactacctgagctacgccgtgtaccagcagggcgacctggacaaggccctgctgctgaccaagaagctgctggagctggaccccgagcaccagagagccaacggcaacctgaagtacttcgagtacatcatggccaaggagaaggacgtgaacaagagcgccagcgacgaccagagcgaccagaagaccacccccaagaagaagggcgtggccgtggactacctgcccgagagacagaagtacgagatgctgtgcagaggcgagggcatcaagatgacccccagaagacagaagaagctgttctgcagataccacgacggcaacagaaaccccaagttcatcctggcccccgccaagcaggaggacgagtgggacaagcccagaatcatcagattccacgacatcatcagcgacgccgagatcgagatcgtgaaggacctggccaagcccagactgagcagagccaccgtgcacgaccccgagaccggcaagctgaccaccgcccagtacagagtgagcaagagcgcctggctgagcggctacgagaaccccgtggtgagcagaatcaacatgagaatccaggacctgaccggcctggacgtgagcaccgccgaggagctgcagaaggacgagcccgacgccttcaaggagctgggcaccggcaacagaatcgccacctggctgttctacatgagcgacgtgagcgccggcggcgccaccgtgttccccgaggtgggcgccagcgtgtggcccaagaagggcaccgccgtgttctggtacaacctgttcgccagcggcgagggcgactacagcaccagacacgccgcctgccccgtgctggtgggcaacaagtgggtgagcaacaagtggctgcacgagagaggccaggagttcagaagaccctgcaccctgagcgagctggagtag

SEQ ID NO: 94696 - DNA, 1608 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggcgagctgcccggcaccaagtaccaggccatgctgagcgtggacgactgcttcggcatgggcagaagcgcctacaacgagggcgactactaccacaccgtgctgtggatggagcaggtgctgaagcagctggacgccggcgaggaggccaccaccaccaagagccaggtgctggactacctgagctacgccgtgttccagctgggcgacctgcacagagccctggagctgaccagaagactgctgagcctggaccccagccacgagagagccggcggcaacctgagatacttcgagcagctgctggaggaggagagagagaagaccctgaccaaccagaccgaggccgagctggccacccccgagggcatctacgagagacccgtggactacctgcccgagagagacgtgtacgagagcctgtgcagaggcgagggcgtgaagctgacccccagaagacagaagagactgttctgcagataccaccacggcaacagagccccccagctgctgatcgcccccttcaaggaggaggacgagtgggacagcccccacatcgtgagatactacgacgtgatgagcgacgaggagatcgagagaatcaaggagatcgccaagcccaagctggccagagccaccgtgagagaccccaagaccggcgtgctgaccgtggccagctacagagtgagcaagagcagctggctggaggaggacgacgaccccgtggtggccagagtgaacagaagaatgcagcacatcaccggcctgaccgtgaagaccgccgagctgctgcaggtggccaactacggcgtgggcggccagtacgagccccacttcgacttcagcagaaacgacgagagagacaccttcaagcacctgggcaccggcaacagagtggccaccttcctgaactacatgagcgacgtggaggccggcggcgccaccgtgttccccgacctgggcgccgccatctggcccaagaagggcaccgccgtgttctggtacaacctgctgagaagcggcgagggcgactacagaaccagacacgccgcctgccccgtgctggtgggctgcaagtgggtgagcaacaagtggttccacgagagaggccaggagttcctgagaccctgcggcagcaccgaggtggactag

SEQ ID NO: 94697 - DNA, 1602 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggcgagctgcccggcaccaagtaccaggccatgctgagcgtggacgactgcttcggcatgggcagaagcgcctacaacgagggcgactactaccacaccgtgctgtggatggagcaggtgctgaagcagctggacgccggcgaggaggccaccaccaccaagagccaggtgctggactacctgagctacgccgtgttccagctgggcgacctgcacagagccctggagctgaccagaagactgctgagcctggaccccagccacgagagagccggcggcaacctgagatacttcgagcagctgctggaggaggagagagagaagaccctgaccaaccagaccgaggccgagctggccacccccgagggcatctacgagagacccgtggactacctgcccgagagagacgtgtacgagagcctgtgcagaggcgagggcgtgaagctgacccccagaagacagaagagactgttctgcagataccaccacggcaacagagccccccagctgctgatcgcccccttcaaggaggaggacgagtgggacagcccccacatcgtgagatactacgacgtgatgagcgacgaggagatcgagagaatcaaggagatcgccaagcccaagctggccagagccaccgtgagagaccccaagaccggcgtgctgaccgtggccagctacagagtgagcaagagcagctggctggaggaggacgacgaccccgtggtggccagagtgaacagaagaatgcagcacatcaccggcctgaccgtgaagaccgccgagctgctgcaggtggccaactacggcgtgggcggccagtacgagccccacttcgacttcagcagaagacccttcgacagcggcctgaagaccgagggcaacagactggccaccttcctgaactacatgagcgacgtggaggccggcggcgccaccgtgttccccgacctgggcgccgccatctggcccaagaagggcaccgccgtgttctggtacaacctgctgagaagcggcgagggcgactacagaaccagacacgccgcctgccccgtgctggtgggctgcaagtgggtgagcaacaagtggttccacgagagaggccaggagttcctgagaccctgcggcagcaccgaggtggactag

SEQ ID NO: 94698 - DNA, 1602 bp, Artificial Sequence; identical to SEQ ID NO: 94697
  Description of Artificial Sequence: Synthetic coding sequence

SEQ ID NO: 94699 - DNA, 1602 bp, Artificial Sequence; identical to SEQ ID NO: 94697
  Description of Artificial Sequence: Synthetic coding sequence

SEQ ID NO: 94700 - DNA, 1608 bp, Artificial Sequence; identical to SEQ ID NO: 94696
  Description of Artificial Sequence: Synthetic coding sequence

SEQ ID NO: 94701 - DNA, 504 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggcgagctgcccggcaccaagtaccaggccatgctgagcgtggactag

SEQ ID NO: 94702 - DNA, 1608 bp, Artificial Sequence; identical to SEQ ID NO: 94696
  Description of Artificial Sequence: Synthetic coding sequence

SEQ ID NO: 94703 - DNA, 306 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggagtag

SEQ ID NO: 94704 - DNA, 615 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggcgagctgcccggcaccaagtaccaggccatgctgagcgtggacgactgcttcggcatgggcagaagcgcctacaacgagggcgactactaccacaccgtgctgtggatggagcaggtgctgaagcagctggacgccggcgaggaggccaccacctag

SEQ ID NO: 94705 - DNA, 345 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgcctag

SEQ ID NO: 94706 - DNA, 444 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggacccctag

SEQ ID NO: 94707 - DNA, 153 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtgtag

SEQ ID NO: 94708 - DNA, 555 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggcgagctgcccggcaccaagtaccaggccatgctgagcgtggacgactgcttcggcatgggcagaagcgcctacaacgagggcgactactaccactag

SEQ ID NO: 94709 - DNA, 462 bp, Artificial Sequence
  Description of Artificial Sequence: Synthetic coding sequence
atgaagctgtgggtgagcgccctgctgatggcctggttcggcgtgctgagctgcgtgcaggccgagttcttcaccagcatcggccacatgaccgacctgatctacgccgagaaggagctggtgcagagcctgaaggagtacatcctggtggaggaggccaagctgagcaagatcaagagctgggccaacaagatggaggccctgaccagcaagagcgccgccgacgccgagggctacctggcccaccccgtgaacgcctacaagctggtgaagagactgaacaccgactggcccgccctggaggacctggtgctgcaggacagcgccgccggcttcatcgccaacctgagcgtgcagagacagttcttccccaccgacgaggacgagatcggcgccgccaaggccctgatgagactgcaggacacctacagactggaccccggcaccatcagcagaggctag

SEQ ID NO: 94710 - DNA, 1635 bp, Artificial Sequence
  Description of Artificial Sequence: Synthetic coding sequence
atgggccccggcgccagactggccgccctgctggccgtgctggccctgggcaccggcgaccccgagagagccgccgccagaggcgacaccttcagcgccctgaccagcgtggccagagccctggcccccgagagaagactgctgggcctgctgagaagatacctgagaggcgaggaggccagactgagagacctgaccagattctacgacaaggtgctgagcctgcacgaggacagcaccacccccgtggccaaccccctgctggccttcaccctgatcaagagactgcagagcgactggagaaacgtggtgcacagcctggaggccagcgagaacatcagagccctgaaggacggctacgagaaggtggagcaggacctgcccgccttcgaggacctggagggcgccgccagagccctgatgagactgcaggacgtgtacatgctgaacgtgaagggcctggccagaggcgtgttccagagagtgaccggcagcgccatcaccgacctgtacagccccaagagactgttcagcctgaccggcgacgactgcttccaggtgggcaaggtggcctacgacatgggcgactactaccacgccatcccctggctggaggaggccgtgagcctgttcagaggcagctacggcgagtggaagaccgaggacgaggccagcctggaggacgccctggaccacctggccttcgcctacttcagagccggcaacgtgagctgcgccctgagcctgagcagagagttcctgctgtacagccccgacaacaagagaatggccagaaacgtgctgaagtacgagagactgctggccgagagccccaaccacgtggtggccgaggccgtgatccagagacccaacatcccccacctgcagaccagagacacctacgagggcctgtgccagaccctgggcagccagcccaccctgtaccagatccccagcctgtactgcagctacgagaccaacagcaacgcctacctgctgctgcagcccatcagaaaggaggtgatccacctggagccctacatcgccctgtaccacgacttcgtgagcgacagcgaggcccagaagatcagagagctggccgagccctggctgcagagaagcgtggtggccagcggcgagaagcagctgcaggtggagtacagaatcagcaagagcgcctggctgaaggacaccgtggaccccaagctggtgaccctgaaccacagaatcgccgccctgaccggcctggacgtgagacccccctacgccgagtacctgcaggtggtgaactacggcatcggcggccactacgagccccacttcgaccacgccaccagccccagcagccccctgtacagaatgaagagcggcaacagagtggccaccttcatgatctacctgagcagcgtggaggccggcggcgccaccgccttcatctacgccaacctgagcgtgcccgtggtgagaaacgccgccctgttctggtggaacctgcacagaagcggcgagggcgacagcgacaccctgcacgccggctgccccgtgctggtgggcgacaagtgggtggccaacaagtggatccacgagtacggccaggagttcagaagaccctgcagcagcagccccgaggactag

SEQ ID NO: 94711 - DNA, 1815 bp, Artificial Sequence
  Description of Artificial Sequence: Synthetic coding sequence
atgggccccggcgccagactggccgccctgctggccgtgctggccctgggcaccggcgaccccgagagagccgccgccagaggcgacaccttcagcgccctgaccagcgtggccagagccctggcccccgagagaagactgctgggcctgctgagaagatacctgagaggcgaggaggccagactgagagacctgaccagattctacgacaaggtgctgagcctgcacgaggacagcaccacccccgtggccaaccccctgctggccttcaccctgatcaagagactgcagagcgactggagaaacgtggtgcacagcctggaggccagcgagaacatcagagccctgaaggacggctacgagaaggtggagcaggacctgcccgccttcgaggacctggagggcgccgccagagccctgatgagactgcaggacgtgtacatgctgaacgtgaagggcctggccagaggcgtgttccagagagtgaccggcagcgccatcaccgacctgtacagccccaagagactgttcagcctgaccggcgacgactgcttccaggtgggcaaggtggcctacgacatgggcgactactaccacgccatcccctggctggaggaggccgtgagcctgttcagaggcagctacggcgagtggaagaccgaggacgaggccagcctggaggacgccctggaccacctggccttcgcctacttcagagccggcaacgtgagctgcgccctgagcctgagcagagagttcctgctgtacagccccgacaacaagagaatggccagaaacgtgctgaagtacgagagactgctggccgagagccccaaccacgtggtggccgaggccgtgatccagagacccaacatcccccacctgcagaccagagacacctacgagggcctgtgccagaccctgggcagccagcccaccctgtaccagatccccagcctgtactgcagctacgagaccaacagcaacgcctacctgctgctgcagcccatcagaaaggaggtgatccacctggagccctacatcgccctgtaccacgacttcgtgagcgacagcgaggcccagaagatcagagagctggccgagccctggctgcagagaagcgtggtggccagcggcgagaagcagctgcaggtggagtacagaatcagcaagagcgcctggctgaaggacaccgtggaccccaagctggtgaccctgaaccacagaatcgccgccctgaccggcctggacgtgagacccccctacgccgagtacctgcaggtggtgaactacggcatcggcggccactacgagccccacttcgaccacgccaccagccccagcagccccctgtacagaatgaagagcggcaacagagtggccaccttcatgatctacctgagcagcgtggaggccggcggcgccaccgccttcatctacgccaacctgagcgtgcccgtggtgagacactgcttcggcggcacctgcaccggcgtggtgaagggcaccgtgacccacttcatgctggccgtgctgagctggtgggagatcagcggctggcccaccagcggctacatgagcatggacagaaacagcgccgaccccgccgcccccgccctgaagaccgagctgctggccgagagaagctggtggagccccgtggccttccagagaagccaggagcccaaggccggcgtgggcgaggagaaggccgagcagccccccggcagaagaccctgccagctgtgcctgtgcctggccaaccagagacagggcagaggctgctaccagggcaccctgagaatgtacatctag

SEQ ID NO: 94712 - DNA, 1527 bp, Artificial Sequence
  Description of Artificial Sequence: Synthetic coding sequence
atgctgagaagagccctgctgtgcctggccgtggccgccctggtgagagccgacgcccccgaggaggaggaccacgtgctggtgctgagaaagagcaacttcgccgaggccctggccgcccacaagtacctgctggtggagttctacgccccctggtgcggccactgcaaggccctggcccccgagtacgccaaggccgccggcaagctgaaggccgagggcagcgagatcagactggccaaggtggacgccaccgaggagagcgacctggcccagcagtacggcgtgagaggctaccccaccatcaagttcttcagaaacggcgacaccgccagccccaaggagtacaccgccggcagagaggccgacgacatcgtgaactggctgaagaagagaaccggccccgccgccaccaccctgcccgacggcgccgccgccgagagcctggtggagagcagcgaggtggccgtgatcggcttcttcaaggacgtggagagcgacagcgccaagcagttcctgcaggccgccgaggccatcgacgacatccccttcggcatcaccagcaacagcgacgtgttcagcaagtaccagctggacaaggacggcgtggtgctgttcaagaagttcgacgagggcagaaacaacttcgagggcgaggtgaccaaggagaacctgctggacttcatcaagcacaaccagctgcccctggtgatcgagttcaccgagcagaccgcccccaagatcttcggcggcgagatcaagacccacatcctgctgttcctgcccaagagcgtgagcgactacgacggcaagctgagcaacttcaagaccgccgccgagagcttcaagggcaagatcctgttcatcttcatcgacagcgaccacaccgacaaccagagaatcctggagttcttcggcctgaagaaggaggagtgccccgccgtgagactgatcaccctggaggaggagatgaccaagtacaagcccgagagcgaggagctgaccgccgagagaatcaccgagttctgccacagattcctggagggcaagatcaagccccacctgatgagccaggagctgcccgaggactgggacaagcagcccgtgaaggtgctggtgggcaagaacttcgaggacgtggccttcgacgagaagaagaacgtgttcgtggagttctacgccccctggtgcggccactgcaagcagctggcccccatctgggacaagctgggcgagacctacaaggaccacgagaacatcgtgatcgccaagatggacagcaccgccaacgaggtggaggccgtgaaggtgcacagcttccccaccctgaagttcttccccgccagcgccgacagaaccgtgatcgactacaacggcgagagaaccctggacggcttcaagaagttcctggagagcggcggccaggacggcgccggcgacgacgacgacctggaggacctggaggaggccgaggagcccgacatggaggaggacgacgaccagaaggccgtgaaggacgagctgtag

SEQ ID NO: 94713 - DNA, 1479 bp, Artificial Sequence
  Description of Artificial Sequence: Synthetic coding sequence
atgctgagaagagccctgctgtgcctggccgtggccgccctggtgagagccgacgcccccgaggaggaggaccacaagtacctgctggtggagttctacgccccctggtgcggccactgcaaggccctggcccccgagtacgccaaggccgccggcaagctgaaggccgagggcagcgagatcagactggccaaggtggacgccaccgaggagagcgacctggcccagcagtacggcgtgagaggctaccccaccatcaagttcttcagaaacggcgacaccgccagccccaaggagtacaccgccggcagagaggccgacgacatcgtgaactggctgaagaagagaaccggccccgccgccaccaccctgcccgacggcgccgccgccgagagcctggtggagagcagcgaggtggccgtgatcggcttcttcaaggacgtggagagcgacagcgccaagcagttcctgcaggccgccgaggccatcgacgacatccccttcggcatcaccagcaacagcgacgtgttcagcaagtaccagctggacaaggacggcgtggtgctgttcaagaagttcgacgagggcagaaacaacttcgagggcgaggtgaccaaggagaacctgctggacttcatcaagcacaaccagctgcccctggtgatcgagttcaccgagcagaccgcccccaagatcttcggcggcgagatcaagacccacatcctgctgttcctgcccaagagcgtgagcgactacgacggcaagctgagcaacttcaagaccgccgccgagagcttcaagggcaagatcctgttcatcttcatcgacagcgaccacaccgacaaccagagaatcctggagttcttcggcctgaagaaggaggagtgccccgccgtgagactgatcaccctggaggaggagatgaccaagtacaagcccgagagcgaggagctgaccgccgagagaatcaccgagttctgccacagattcctggagggcaagatcaagccccacctgatgagccaggagctgcccgaggactgggacaagcagcccgtgaaggtgctggtgggcaagaacttcgaggacgtggccttcgacgagaagaagaacgtgttcgtggagttctacgccccctggtgcggccactgcaagcagctggcccccatctgggacaagctgggcgagacctacaaggaccacgagaacatcgtgatcgccaagatggacagcaccgccaacgaggtggaggccgtgaaggtgcacagcttccccaccctgaagttcttccccgccagcgccgacagaaccgtgatcgactacaacggcgagagaaccctggacggcttcaagaagttcctggagagcggcggccaggacggcgccggcgacgacgacgacctggaggacctggaggaggccgaggagcccgacatggaggaggacgacgaccagaaggccgtgaaggacgagctgtag

SEQ ID NO: 94714 - DNA, 1356 bp, Artificial Sequence
  Description of Artificial Sequence: Synthetic coding sequence
atgctgagaagagccctgctgtgcctggccgtggccgccctggtgagagccgacgcccccgaggaggaggaccacgtgctggtgctgagaaagagcaacttcgccgaggccctggccgcccacaagtacctgctggtggagttctacgccccctggtgcggccactgcaaggccctggcccccgagtacgccaaggccgccggcaagctgaaggccgagggcagcgagatcagactggccaaggtggacgccaccgaggagagcgacctggcccagcagtacggcgtgagaggctaccccaccatcaagttcttcagaaacggcgacaccgccagccccaaggagtacaccgccggcagagaggccgacgacatccccttcggcatcaccagcaacagcgacgtgttcagcaagtaccagctggacaaggacggcgtggtgctgttcaagaagttcgacgagggcagaaacaacttcgagggcgaggtgaccaaggagaacctgctggacttcatcaagcacaaccagctgcccctggtgatcgagttcaccgagcagaccgcccccaagatcttcggcggcgagatcaagacccacatcctgctgttcctgcccaagagcgtgagcgactacgacggcaagctgagcaacttcaagaccgccgccgagagcttcaagggcaagatcctgttcatcttcatcgacagcgaccacaccgacaaccagagaatcctggagttcttcggcctgaagaaggaggagtgccccgccgtgagactgatcaccctggaggaggagatgaccaagtacaagcccgagagcgaggagctgaccgccgagagaatcaccgagttctgccacagattcctggagggcaagatcaagccccacctgatgagccaggagctgcccgaggactgggacaagcagcccgtgaaggtgctggtgggcaagaacttcgaggacgtggccttcgacgagaagaagaacgtgttcgtggagttctacgccccctggtgcggccactgcaagcagctggcccccatctgggacaagctgggcgagacctacaaggaccacgagaacatcgtgatcgccaagatggacagcaccgccaacgaggtggaggccgtgaaggtgcacagcttccccaccctgaagttcttccccgccagcgccgacagaaccgtgatcgactacaacggcgagagaaccctggacggcttcaagaagttcctggagagcggcggccaggacggcgccggcgacgacgacgacctggaggacctggaggaggccgaggagcccgacatggaggaggacgacgaccagaaggccgtgaaggacgagctgtag

SEQ ID NO: 94715 - DNA, 2133 bp, Artificial Sequence
  Description of Artificial Sequence: Synthetic coding sequence
atgctgagcctgcagtaccccgacgtgtacagagacgagaccgccgtgcaggactaccacggccacaagatctgcgacccctacgcctggctggaggaccccgacagcgagcagaccaaggccttcgtggaggcccagaacaagatcaccgtgcccttcctggagcagtgccccatcagaggcctgtacaaggagagaatgaccgagctgtacgactaccccaagtacagctgccacttcaagaagggcaagagatacttctacttctacaacaccggcctgcagaaccagagagtgctgtacgtgcaggacagcctggagggcgaggccagagtgttcctggaccccaacatcctgagcgacgacggcaccgtggccctgagaggctacgccttcagcgaggacggcgagtacttcgcctacggcctgagcgccagcggcagcgactgggtgaccatcaagttcatgaaggtggacggcgccaaggagctgcccgacgtgctggagagagtgaagttcagctgcatggcctggacccacgacggcaagggcatgttctacaacagctacccccagcaggacggcaagagcgacggcaccgagaccagcaccaacctgcaccagaagctgtactaccacgtgctgggcaccgaccagagcgaggacatcctgtgcgccgagttccccgacgagcccaagtggatgggcggcgccgagctgagcgacgacggcagatacgtgctgctgagcatcagagagggctgcgaccccgtgaacagactgtggtactgcgacctgcagcaggagagcagcggcatcgccggcatcctgaagtgggtgaagctgatcgacaacttcgagggcgagtacgactacgtgaccaacgagggcaccgtgttcaccttcaagaccaacagacagagccccaactacagagtgatcaacatcgacttcagagaccccgaggagagcaagtggaaggtgctggtgcccgagcacgagaaggacgtgctggagtggatcgcctgcgtgagaagcaacttcctggtgctgtgctacctgcacgacgtgaagaacatcctgcagctgcacgacctgaccaccggcgccctgctgaagaccttccccctggacgtgggcagcatcgtgggctacagcggccagaagaaggacaccgagatcttctaccagttcaccagcttcctgagccccggcatcatctaccactgcgacctgaccaaggaggagctggagcccagagtgttcagagaggtgaccgtgaagggcatcgacgccagcgactaccagaccgtgcagatcttctaccccagcaaggacggcaccaagatccccatgttcatcgtgcacaagaagggcatcaagctggacggcagccaccccgccttcctgtacggctacggcggcttcaacatcagcatcacccccaactacagcgtgagcagactgatcttcgtgagacacatgggcggcatcctggccgtggccaacatcagaggcggcggcgagtacggcgagacctggcacaagggcggcatcctggccaacaagcagaactgcttcgacgacttccagtgcgccgccgagtacctgatcaaggagggctacaccagccccaagagactgaccatcaacggcggcagcaacggcggcctgctggtggccgcctgcgccaaccagagacccgacctgttcggctgcgtgatcgcccaggtgggcgtgatggacatgctgaagttccacaagtacaccatcggccacgcctggaccaccgactacggctgcagcgacagcaagcagcacttcgagtggctggtgaagtacagccccctgcacaacgtgaagctgcccgaggccgacgacatccagtaccccagcatgctgctgctgaccgccgaccacgacgacagagtggtgcccctgcacagcctgaagttcatcgccaccctgcagtacatcgtgggcagaagcagaaagcagagcaaccccctgctgatccacgtggacaccaaggccggccacggcgccggcaagcccaccgccaaggtgatcgaggaggtgagcgacatgttcgccttcatcgccagatgcctgaacgtggactggatcccctag

SEQ ID NO: 94716 - DNA, 138 bp, Artificial Sequence
  Description of Artificial Sequence: Synthetic coding sequence
tgaatcatctaccactgcgacctgaccaaggaggagctggagcccagagtgttcagagaggtgaccgtgaagggcatcgacgccagcgactaccagaccgtgcagctgcccaagggcaccgagagcagcagaaactag

SEQ ID NO: 94717 - DNA, 135 bp, Artificial Sequence
  Description of Artificial Sequence: Synthetic coding sequence
atcatctaccactgcgacctgaccaaggaggagctggagcccagagtgttcagagaggtgaccgtgaagggcatcgacgccagcgactaccagaccgtgcagctgcccaagggcaccgagagcagcagaaactag

SEQ ID NO: 94718 - DNA, 2184 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaacttcgccgaccactgctacaacagaatcaagctgaagaagtaccacctgaccaagtgcctgcagaacaagcccaagatcagcgagctggccagaaacatccccagcagaagcttcagctgcaaggacctgcagcccgtgaagcaggagaacgagaagcccctgcccgagaacatggacgccttcgagaaggtgagaaccaagctggagacccagccccaggaggagtacgagatcatcaacgtggaggtgaagcacggcggcttcgtgtactaccaggagggctgctgcctggtgagaagcaaggacgaggaggccgacaacgacaactacgaggtgctgttcaacctggaggagctgaagctggaccagcccttcatcgactgcatcagagtggcccccgacgagaagtacgtggccgccaagatcagaaccgaggacagcgaggccagcacctgcgtgatcatcaagctgagcgaccagcccgtgatggaggccagcttccccaacgtgagcagcttcgagtgggtgaaggacgaggaggacgaggacgtgctgttctacaccttccagagaaacctgagatgccacgacgtgtacagagccaccttcggcgacaacaagagaaacgagagattctacaccgagaaggaccccagctacttcgtgttcctgtacctgaccaaggacagcagattcctgaccatcaacatcatgaacaagaccaccagcgaggtgtggctgatcgacggcctgagcccctgggacccccccgtgctgatccagaagagaatccacggcgtgctgtactacgtggagcacagagacgacgagctgtacatcctgaccaacgtgggcgagcccaccgagttcaagctgatgagaaccgccgccgacacccccgccatcatgaactgggacctgttcttcaccatgaagagaaacaccaaggtgatcgacctggacatgttcaaggaccactgcgtgctgttcctgaagcacagcaacctgctgtacgtgaacgtgatcggcctggccgacgacagcgtgagaagcctgaagctgcccccctgggcctgcggcttcatcatggacaccaacagcgaccccaagaactgccccttccagctgtgcagccccatcagaccccccaagtactacacctacaagttcgccgagggcaagctgttcgaggagaccggccacgaggaccccatcaccaagaccagcagagtgctgagactggaggccaagagcaaggacggcaagctggtgcccatgaccgtgttccacaagaccgacagcgaggacctgcagaagaagcccctgctggtgcacgtgtacggcgcctacggcatggacctgaagatgaacttcagacccgagagaagagtgctggtggacgacggctggatcctggcctactgccacgtgagaggcggcggcgagctgggcctgcagtggcacgccgacggcagactgaccaagaagctgaacggcctggccgacctggaggcctgcatcaagaccctgcacggccagggcttcagccagcccagcctgaccaccctgaccgccttcagcgccggcggcgtgctggccggcgccctgtgcaacagcaaccccgagctggtgagagccgtgaccctggaggcccccttcctggacgtgctgaacaccatgatggacaccaccctgcccctgaccctggaggagctggaggagtggggcaaccccagcagcgacgagaagcacaagaactacatcaagagatactgcccctaccagaacatcaagccccagcactaccccagcatccacatcaccgcctacgagaacgacgagagagtgcccctgaagggcatcgtgagctacaccgagaagctgaaggaggccatcgccgagcacgccaaggacaccggcgagggctaccagacccccaacatcatcctggacatccagcccggcggcaaccacgtgatcgaggacagccacaagaagatcaccgcccagatcaagttcctgtacgaggagctgggcctggacagcaccagcgtgttcgaggacctgaagaagtacctgaagttctag

SEQ ID NO: 94719 - DNA, 1998 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaacttcgccgaccactgctacaacagaatcaagctgaagaagtaccacctgaccaagtgcctgcagaacaagcccaagatcagcgagctggccagaaacatccccagcagaagcttcagctgcaaggacctgcagcccgtgaagcaggagaacgagaagcccctgcccgagaacatggacgccttcgagaaggtgagaaccaagctggagacccagccccaggaggagtacgagatcatcaacgtggaggtgaagcacggcggcttcgtgtactaccaggagggctgctgcctggtgagaagcaaggacgaggaggccgacaacgacaactacgaggtgctgttcaacctggaggagctgaagctggaccagcccttcatcgactgcatcagagtggcccccgacgagaagtacgtggccgccaagatcagaaccgaggacagcgaggccagcacctgcgtgatcatcaagctgagcgaccagcccgtgatggaggccagcttccccaacgtgagcagcttcgagtgggtgaaggacgaggaggacgaggacgtgctgttctacaccttccagagaaacctgagatgccacgacgtgtacagagccaccttcggcgacaacaagagaaacgagagattctacaccgagaaggaccccagctacttcgtgttcctgtacctgaccaaggacagcagattcctgaccatcaacatcatgaacaagaccaccagcgaggtgtggctgatcgacggcctgagcccctgggacccccccgtgctgatccagaagagaatccacggcgtgctgtactacgtggagcacagagacgacgagctgtacatcctgaccaacgtgggcgagcccaccgagttcaagctgcccccctgggcctgcggcttcatcatggacaccaacagcgaccccaagaactgccccttccagctgtgcagccccatcagaccccccaagtactacacctacaagttcgccgagggcaagctgttcgaggagaccggccacgaggaccccatcaccaagaccagcagagtgctgagactggaggccaagagcaaggacggcaagctggtgcccatgaccgtgttccacaagaccgacagcgaggacctgcagaagaagcccctgctggtgcacgtgtacggcgcctacggcatggacctgaagatgaacttcagacccgagagaagagtgctggtggacgacggctggatcctggcctactgccacgtgagaggcggcggcgagctgggcctgcagtggcacgccgacggcagactgaccaagaagctgaacggcctggccgacctggaggcctgcatcaagaccctgcacggccagggcttcagccagcccagcctgaccaccctgaccgccttcagcgccggcggcgtgctggccggcgccctgtgcaacagcaaccccgagctggtgagagccgtgaccctggaggcccccttcctggacgtgctgaacaccatgatggacaccaccctgcccctgaccctggaggagctggaggagtggggcaaccccagcagcgacgagaagcacaagaactacatcaagagatactgcccctaccagaacatcaagccccagcactaccccagcatccacatcaccgcctacgagaacgacgagagagtgcccctgaagggcatcgtgagctacaccgagaagctgaaggaggccatcgccgagcacgccaaggacaccggcgagggctaccagacccccaacatcatcctggacatccagcccggcggcaaccacgtgatcgaggacagccacaagaagatcaccgcccagatcaagttcctgtacgaggagctgggcctggacagcaccagcgtgttcgaggacctgaagaagtacctgaagttctag

SEQ ID NO: 94720 - DNA, 1986 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaacttcgccgaccactgctacaacagaatcaagctgaagaagtaccacctgaccaagtgcctgcagaacaagcccaagatcagcgagctggccagaaacatccccagcagaagcttcagctgcaaggacctgcagcccgtgaagcaggagaacgagaagcccctgcccgagaacatggacgccttcgagaaggtgagaaccaagctggagacccagccccaggaggagtacgagatcatcaacgtggaggtgaagcacggcggcttcgtgtactaccaggagggctgctgcctggtgagaagcaaggacgaggaggccgacaacgacaactacgaggtgctgttcaacctggaggagctgaagctggaccagcccttcatcgactgcatcagagtggcccccgacgagaagtacgtggccgccaagatcagaaccgaggacagcgaggccagcacctgcgtgatcatcaagctgagcgaccagcccgtgatggaggccagcttccccaacgtgagcagcttcgagtgggtgaaggacgaggaggacgaggacgtgctgttctacaccttccagagaaacctgagatgccacgacgtgtacagagccaccttcggcgacaacaagagaaacgagagattctacaccgagaaggaccccagctacttcgtgttcctgtacctgaccaaggacagcagattcctgaccatcaacatcatgaacaagaccaccagcgaggtgtggctgatcgacggcctgagcccctgggacccccccgtgctgatccagaagagaatccacggcgtgctgtactacgtggagcacagagacgacgagctgtacatcctgaccaacgtgggcgagcccaccgagttcaagctgatgagaaccgccgccgacacccccgccatcatgaactgggacctgttcttcaccatgaagagaaacaccaaggtgatcgacctggacatgttcaaggaccactgcgtgctgttcctgaagcacagcaacctgctgtacgtgaacgtgatcggcctggccgacgacagcgtgagaagcctgaaggacggcaagctggtgcccatgaccgtgttccacaagaccgacagcgaggacctgcagaagaagcccctgctggtgcacgtgtacggcgcctacggcatggacctgaagatgaacttcagacccgagagaagagtgctggtggacgacggctggatcctggcctactgccacgtgagaggcggcggcgagctgggcctgcagtggcacgccgacggcagactgaccaagaagctgaacggcctggccgacctggaggcctgcatcaagaccctgcacggccagggcttcagccagcccagcctgaccaccctgaccgccttcagcgccggcggcgtgctggccggcgccctgtgcaacagcaaccccgagctggtgagagccgtgaccctggaggcccccttcctggacgtgctgaacaccatgatggacaccaccctgcccctgaccctggaggagctggaggagtggggcaaccccagcagcgacgagaagcacaagaactacatcaagagatactgcccctaccagaacatcaagccccagcactaccccagcatccacatcaccgcctacgagaacgacgagagagtgcccctgaagggcatcgtgagctacaccgagaagctgaaggaggccatcgccgagcacgccaaggacaccggcgagggctaccagacccccaacatcatcctggacatccagcccggcggcaaccacgtgatcgaggacagccacaagaagatcaccgcccagatcaagttcctgtacgaggagctgggcctggacagcaccagcgtgttcgaggacctgaagaagtacctgaagttctag

SEQ ID NO: 94721 - DNA, 2184 bp, Artificial Sequence; identical to SEQ ID NO: 94718
  Description of Artificial Sequence: Synthetic coding sequence

SEQ ID NO: 94722 - DNA, 2184 bp, Artificial Sequence; identical to SEQ ID NO: 94718
  Description of Artificial Sequence: Synthetic coding sequence

SEQ ID NO: 94723 - DNA, 2184 bp, Artificial Sequence; identical to SEQ ID NO: 94718
  Description of Artificial Sequence: Synthetic coding sequence

SEQ ID NO: 94724 - DNA, 2184 bp, Artificial Sequence; identical to SEQ ID NO: 94718
  Description of Artificial Sequence: Synthetic coding sequence

SEQ ID NO: 94725 - DNA, 2184 bp, Artificial Sequence; identical to SEQ ID NO: 94718
  Description of Artificial Sequence: Synthetic coding sequence

SEQ ID NO: 94726 - DNA, 456 bp, Artificial Sequence
  Description of Artificial Sequence: Synthetic coding sequence
atgcagcagaagaccaagctgttcctgcaggccctgaagtacagcatcccccacctgggcaagtgcatgcagaagcagcacctgaaccactacaacttcgccgaccactgctacaacagaatcaagctgaagaagtaccacctgaccaagtgcctgcagaacaagcccaagatcagcgagctggccagaaacatccccagcagaagcttcagctgcaaggacctgcagcccgtgaagcaggagaacgagaagcccctgcccgagaacatggacgccttcgagaaggtgagaaccaagctggagacccagccccaggaggagtacgagatcatcaacgtggaggtgaagcacggcggcttcgtgtactaccaggagggctgctgcctggtgagaagcaaggacgaggaggccgacaacgacaactacgaggtgctgttcaacctggaggagctgtag

SEQ ID NO: 94727 - DNA, 1917 bp, Artificial Sequence
  Description of Artificial Sequence: Synthetic coding sequence
atggacgccttcgagaaggtgagaaccaagctggagacccagccccaggaggagtacgagatcatcaacgtggaggtgaagcacggcggcttcgtgtactaccaggagggctgctgcctggtgagaagcaaggacgaggaggccgacaacgacaactacgaggtgctgttcaacctggaggagctgaagctggaccagcccttcatcgactgcatcagagtggcccccgacgagaagtacgtggccgccaagatcagaaccgaggacagcgaggccagcacctgcgtgatcatcaagctgagcgaccagcccgtgatggaggccagcttccccaacgtgagcagcttcgagtgggtgaaggacgaggaggacgaggacgtgctgttctacaccttccagagaaacctgagatgccacgacgtgtacagagccaccttcggcgacaacaagagaaacgagagattctacaccgagaaggaccccagctacttcgtgttcctgtacctgaccaaggacagcagattcctgaccatcaacatcatgaacaagaccaccagcgaggtgtggctgatcgacggcctgagcccctgggacccccccgtgctgatccagaagagaatccacggcgtgctgtactacgtggagcacagagacgacgagctgtacatcctgaccaacgtgggcgagcccaccgagttcaagctgatgagaaccgccgccgacacccccgccatcatgaactgggacctgttcttcaccatgaagagaaacaccaaggtgatcgacctggacatgttcaaggaccactgcgtgctgttcctgaagcacagcaacctgctgtacgtgaacgtgatcggcctggccgacgacagcgtgagaagcctgaagctgcccccctgggcctgcggcttcatcatggacaccaacagcgaccccaagaactgccccttccagctgtgcagccccatcagaccccccaagtactacacctacaagttcgccgagggcaagctgttcgaggagaccggccacgaggaccccatcaccaagaccagcagagtgctgagactggaggccaagagcaaggacggcaagctggtgcccatgaccgtgttccacaagaccgacagcgaggacctgcagaagaagcccctgctggtgcacgtgtacggcgcctacggcatggacctgaagatgaacttcagacccgagagaagagtgctggtggacgacggctggatcctggcctactgccacgtgagaggcggcggcgagctgggcctgcagtggcacgccgacggcagactgaccaagaagctgaacggcctggccgacctggaggcctgcatcaagaccctgcacggccagggcttcagccagcccagcctgaccaccctgaccgccttcagcgccggcggcgtgctggccggcgccctgtgcaacagcaaccccgagctggtgagagccgtgaccctggaggcccccttcctggacgtgctgaacaccatgatggacaccaccctgcccctgaccctggaggagctggaggagtggggcaaccccagcagcgacgagaagcacaagaactacatcaagagatactgcccctaccagaacatcaagccccagcactaccccagcatccacatcaccgcctacgagaacgacgagagagtgcccctgaagggcatcgtgagctacaccgagaagctgaaggaggccatcgccgagcacgccaaggacaccggcgagggctaccagacccccaacatcatcctggacatccagcccggcggcaaccacgtgatcgaggacagccacaagaagatcaccgcccagatcaagttcctgtacgaggagctgggcctggacagcaccagcgtgttcgaggacctgaagaagtacctgaagttctag

SEQ ID NO: 94728 - DNA, 1491 bp, Artificial Sequence
  Description of Artificial Sequence: Synthetic coding sequence
atgggcagaagagccctgctgctgctgctgctgagcttcctggccccctgggccaccatcgccctgagacccgccctgagagccctgggcagcctgcacctgcccaccaaccccaccagcctgcccgccgtggccaagaactacagcgtgctgtacttccagcagaaggtggaccacttcggcttcaacaccgtgaagaccttcaaccagagatacctggtggccgacaagtactggaagaagaacggcggcagcatcctgttctacaccggcaacgagggcgacatcatctggttctgcaacaacaccggcttcatgtgggacgtggccgaggagctgaaggccatgctggtgttcgccgagcacagatactacggcgagagcctgcccttcggcgacaacagcttcaaggacagcagacacctgaacttcctgaccagcgagcaggccctggccgacttcgccgagctgatcaagcacctgaagagaaccatccccggcgccgagaaccagcccgtgatcgccatcggcggcagctacggcggcatgctggccgcctggttcagaatgaagtacccccacatggtggtgggcgccctggccgccagcgcccccatctggcagttcgaggacctggtgccctgcggcgtgttcatgaagatcgtgaccaccgacttcagaaagagcggcccccactgcagcgagagcatccacagaagctgggacgccatcaacagactgagcaacaccggcagcggcctgcagtggctgaccggcgccctgcacctgtgcagccccctgaccagccaggacatccagcacctgaaggactggatcagcgagacctgggtgaacctggccatggtggactacccctacgccagcaacttcctgcagcccctgcccgcctggcccatcaaggtggtgtgccagtacctgaagaaccccaacgtgagcgacagcctgctgctgcagaacatcttccaggccctgaacgtgtactacaactacagcggccaggtgaagtgcctgaacatcagcgagaccgccaccagcagcctgggcaccctgggctggagctaccaggcctgcaccgaggtggtgatgcccttctgcaccaacggcgtggacgacatgttcgagccccacagctggaacctgaaggagctgagcgacgactgcttccagcagtggggcgtgagacccagacccagctggatcaccaccatgtacggcggcaagaacatcagcagccacaccaacatcgtgttcagcaacggcgagctggacccctggagcggcggcggcgtgaccaaggacatcaccgacaccctggtggccgtgaccatcagcgagggcgcccaccacctggacctgagaaccaagaacgccctggaccccatgagcgtgctgctggccagaagcctggaggtgagacacatgaagaactggatcagagacttctacgacagcgccggcaagcagcactag

SEQ ID NO: 94729 - DNA, 1554 bp, Artificial Sequence
  Description of Artificial Sequence: Synthetic coding sequence
atgggcagaagagccctgctgctgctgctgctgagcttcctggccccctgggccaccatcgccctgagacccgccctgagagccctgggcagcctgcacctgcccaccaaccccaccagcctgcccgccgtggccaagaactacagcgtgctgtacttccagcagaaggccctggccgccggccagctgcacatctgcatcatccagctgaaccactacaagacccccctggtggaccacttcggcttcaacaccgtgaagaccttcaaccagagatacctggtggccgacaagtactggaagaagaacggcggcagcatcctgttctacaccggcaacgagggcgacatcatctggttctgcaacaacaccggcttcatgtgggacgtggccgaggagctgaaggccatgctggtgttcgccgagcacagatactacggcgagagcctgcccttcggcgacaacagcttcaaggacagcagacacctgaacttcctgaccagcgagcaggccctggccgacttcgccgagctgatcaagcacctgaagagaaccatccccggcgccgagaaccagcccgtgatcgccatcggcggcagctacggcggcatgctggccgcctggttcagaatgaagtacccccacatggtggtgggcgccctggccgccagcgcccccatctggcagttcgaggacctggtgccctgcggcgtgttcatgaagatcgtgaccaccgacttcagaaagagcggcccccactgcagcgagagcatccacagaagctgggacgccatcaacagactgagcaacaccggcagcggcctgcagtggctgaccggcgccctgcacctgtgcagccccctgaccagccaggacatccagcacctgaaggactggatcagcgagacctgggtgaacctggccatggtggactacccctacgccagcaacttcctgcagcccctgcccgcctggcccatcaaggtggtgtgccagtacctgaagaaccccaacgtgagcgacagcctgctgctgcagaacatcttccaggccctgaacgtgtactacaactacagcggccaggtgaagtgcctgaacatcagcgagaccgccaccagcagcctgggcaccctgggctggagctaccaggcctgcaccgaggtggtgatgcccttctgcaccaacggcgtggacgacatgttcgagccccacagctggaacctgaaggagctgagcgacgactgcttccagcagtggggcgtgagacccagacccagctggatcaccaccatgtacggcggcaagaacatcagcagccacaccaacatcgtgttcagcaacggcgagctggacccctggagcggcggcggcgtgaccaaggacatcaccgacaccctggtggccgtgaccatcagcgagggcgcccaccacctggacctgagaaccaagaacgccctggaccccatgagcgtgctgctggccagaagcctggaggtgagacacatgaagaactggatcagagacttctacgacagcgccggcaagcagcactag

SEQ ID NO: 94730 - DNA, 1176 bp, Artificial Sequence
  Description of Artificial Sequence: Synthetic coding sequence
atgtgggacgtggccgaggagctgaaggccatgctggtgttcgccgagcacagatactacggcgagagcctgcccttcggcgacaacagcttcaaggacagcagacacctgaacttcctgaccagcgagcaggccctggccgacttcgccgagctgatcaagcacctgaagagaaccatccccggcgccgagaaccagcccgtgatcgccatcggcggcagctacggcggcatgctggccgcctggttcagaatgaagtacccccacatggtggtgggcgccctggccgccagcgcccccatctggcagttcgaggacctggtgccctgcggcgtgttcatgaagatcgtgaccaccgacttcagaaagagcggcccccactgcagcgagagcatccacagaagctgggacgccatcaacagactgagcaacaccggcagcggcctgcagtggctgaccggcgccctgcacctgtgcagccccctgaccagccaggacatccagcacctgaaggactggatcagcgagacctgggtgaacctggccatggtggactacccctacgccagcaacttcctgcagcccctgcccgcctggcccatcaaggtggtgtgccagtacctgaagaaccccaacgtgagcgacagcctgctgctgcagaacatcttccaggccctgaacgtgtactacaactacagcggccaggtgaagtgcctgaacatcagcgagaccgccaccagcagcctgggcaccctgggctggagctaccaggcctgcaccgaggtggtgatgcccttctgcaccaacggcgtggacgacatgttcgagccccacagctggaacctgaaggagctgagcgacgactgcttccagcagtggggcgtgagacccagacccagctggatcaccaccatgtacggcggcaagaacatcagcagccacaccaacatcgtgttcagcaacggcgagctggacccctggagcggcggcggcgtgaccaaggacatcaccgacaccctggtggccgtgaccatcagcgagggcgcccaccacctggacctgagaaccaagaacgccctggaccccatgagcgtgctgctggccagaagcctggaggtgagacacatgaagaactggatcagagacttctacgacagcgccggcaagcagcactag

SEQ ID NO: 94731 - DNA, 1428 bp, Artificial Sequence
  Description of Artificial Sequence: Synthetic coding sequence
atggagggcctgctgaccagatgcagagccctgcccgccctggccacctgcagcagacagctgagcggctacgtgccctgcagattccaccactgcgcccccagaagaggcagaagactgctgctgagcagagtgttccagccccagaacctgagagaggacagagtgctgagcctgcaggacaagagcgacgacctgacctgcaagagccagagactgatgctgcaggtgggcctgatctaccccgccagccccggctgctaccacctgctgccctacaccgtgagagccatggagaagctggtgagagtgatcgaccaggagatgcaggccatcggcggccagaaggtgaacatgcccagcctgagccccgccgagctgtggcaggccaccaacagatgggacctgatgggcaaggagctgctgagactgagagacagacacggcaaggagtactgcctgggccccacccacgaggaggccatcaccgccctgatcgccagccagaagaagctgagctacaagcagctgcccttcctgctgtaccaggtgaccagaaagttcagagacgagcccagacccagattcggcctgctgagaggcagagagttctacatgaaggacatgtacaccttcgacagcagccccgaggccgcccagcagacctacagcctggtgtgcgacgcctactgcagcctgttcaacaagctgggcctgcccttcgtgaaggtgcaggccgacgtgggcaccatcggcggcaccgtgagccacgagttccagctgcccgtggacatcggcgaggacagactggccatctgccccagatgcagcttcagcgccaacatggagaccctggacctgagccagatgaactgccccgcctgccagggccccctgaccaagaccaagggcatcgaggtgggccacaccttctacctgggcaccaagtacagcagcatcttcaacgcccagttcaccaacgtgtgcggcaagcccaccctggccgagatgggctgctacggcctgggcgtgaccagaatcctggccgccgccatcgaggtgctgagcaccgaggactgcgtgagatggcccagcctgctggccccctaccaggcctgcctgatcccccccaagaagggcagcaaggagcaggccgccagcgagctgatcggccagctgtacgaccacatcaccgaggccgtgccccagctgcacggcgaggtgctgctggacgacagaacccacctgaccatcggcaacagactgaaggacgccaacaagttcggctaccccttcgtgatcatcgccggcaagagagccctggaggaccccgcccacttcgaggtgtggtgccagaacaccggcgaggtggccttcctgaccaaggacggcgtgatggacctgctgacccccgtgcagaccgtgtag

SEQ ID NO: 94732 - DNA, 498 bp, Artificial Sequence
  Description of Artificial Sequence: Synthetic coding sequence
atggccaagatgaacctgagcagctacatcctgatcctgaccttcagcctgttcagccagggcatcctgctgagcgccagcaagagcatcagaaacctggacgacgacatggtgttcaacaccttcagactgggcaagggcttccagaaggaggacaccgccgagaagagcgtgatcgcccccagcctggagcagtacaagaacgacgagagcagcttcatgaacgaggaggagaacaaggtgagcaagaacaccggcagcaagcacaacttcctgaaccacggcctgcccctgaacctggccatcaagccctacctggccctgaagggcagcgtggccttccccgccgagaacggcgtgcagaacaccgagagcacccaggagaagagagagatcggcgacgaggagaacagcgccaagttccccatcggcagaagagacttcgacatgctgagatgcatgctgggcagagtgtacagaccctgctggcaggtgtag

SEQ ID NO: 94733 - DNA, 2598 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctggtgcacatcttcctgtacgtggtgcagcccagagacttccccgaggacaccctgagaaagttcctgcagaaggcctacgagagcaagatcgactacgacaagcccgagaccgtgatcctgggcctgaagatcgtgtactacgaggccggcatcatcctgtgctgcgtgctgggcctgctgttcatcatcctgatgcccctggtgggctacttcttctgcatgtgcagatgctgcaacaagtgcggcggcgagatgcaccagagacagaaggagaacggccccttcctgagaaagtgcttcgccatcagcctgctggtgatctgcatcatcatcagcatcggcatcttctacggcttcgtggccaaccaccaggtgagaaccagaatcaagagaagcagaaagctggccgacagcaacttcaaggacctgagaaccctgctgaacgagacccccgagcagatcaagtacatcctggcccagtacaacaccaccaaggacaaggccttcaccgacctgaacagcatcaacagcgtgctgggcggcggcatcctggacagactgagacccaacatcatccccgtgctggacgagatcaagagcatggccaccgccatcaaggagaccaaggaggccctggagaacatgaacagcaccctgaagagcctgcaccagcagagcacccagctgagcagcagcctgaccagcgtgaagaccagcctgagaagcagcctgaacgaccccctgtgcctggtgcaccccagcagcgagacctgcaacagcatcagactgagcctgagccagctgaacagcaaccccgagctgagacagctgccccccgtggacgccgagctggacaacgtgaacaacgtgctgagaaccgacctggacggcctggtgcagcagggctaccagagcctgaacgacatccccgacagagtgcagagacagaccaccaccgtggtggccggcatcaagagagtgctgaacagcatcggcagcgacatcgacaacgtgacccagagactgcccatccaggacatcctgagcgccttcagcgtgtacgtgaacaacaccgagagctacatccacagaaacctgcccaccctggaggagtacgacagctactggtggctgggcggcctggtgatctgcagcctgctgaccctgatcgtgatcttctactacctgggcctgctgtgcggcgtgtgcggctacgacagacacgccacccccaccaccagaggctgcgtgagcaacaccggcggcgtgttcctgatggtgggcgtgggcctgagcttcctgttctgctggatcctgatgatcatcgtggtgctgaccttcgtgttcggcgccaacgtggagaagctgatctgcgagccctacaccagcaaggagctgttcagagtgctggacaccccctacctgctgaacgaggactgggagtactacctgagcggcaagctgttcaacaagagcaagatgaagctgaccttcgagcaggtgtacagcgactgcaagaagaacagaggcacctacggcaccctgcacctgcagaacagcttcaacatcagcgagcacctgaacatcaacgagcacaccggcagcatcagcagcgagctggagagcctgaaggtgaacctgaacatcttcctgctgggcgccgccggcagaaagaacctgcaggacttcgccgcctgcggcatcgacagaatgaactacgacagctacctggcccagaccggcaagagccccgccggcgtgaacctgctgagcttcgcctacgacctggaggccaaggccaacagcctgccccccggcaacctgagaaacagcctgaagagagacgcccagaccatcaagaccatccaccagcagagagtgctgcccatcgagcagagcctgagcaccctgtaccagagcgtgaagatcctgcagagaaccggcaacggcctgctggagagagtgaccagaatcctggccagcctggacttcgcccagaacttcatcaccaacaacaccagcagcgtgatcatcgaggagaccaagaagtacggcagaaccatcatcggctacttcgagcactacctgcagtggatcgagttcagcatcagcgagaaggtggccagctgcaagcccgtggccaccgccctggacaccgccgtggacgtgttcctgtgcagctacatcatcgaccccctgaacctgttctggttcggcatcggcaaggccaccgtgttcctgctgcccgccctgatcttcgccgtgaagctggccaagtactacagaagaatggacagcgaggacgtgtacgacgacgtggagaccatccccatgaagaacatggagaacggcaacaacggctaccacaaggaccacgtgtacggcatccacaaccccgtgatgaccagccccagccagcactag

SEQ ID NO: 94734 - DNA, 2571 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctggtgcacatcttcctgtacgtggtgcagcccagagacttccccgaggacaccctgagaaagttcctgcagaaggcctacgagagcaagatcgactacgacaagatcgtgtactacgaggccggcatcatcctgtgctgcgtgctgggcctgctgttcatcatcctgatgcccctggtgggctacttcttctgcatgtgcagatgctgcaacaagtgcggcggcgagatgcaccagagacagaaggagaacggccccttcctgagaaagtgcttcgccatcagcctgctggtgatctgcatcatcatcagcatcggcatcttctacggcttcgtggccaaccaccaggtgagaaccagaatcaagagaagcagaaagctggccgacagcaacttcaaggacctgagaaccctgctgaacgagacccccgagcagatcaagtacatcctggcccagtacaacaccaccaaggacaaggccttcaccgacctgaacagcatcaacagcgtgctgggcggcggcatcctggacagactgagacccaacatcatccccgtgctggacgagatcaagagcatggccaccgccatcaaggagaccaaggaggccctggagaacatgaacagcaccctgaagagcctgcaccagcagagcacccagctgagcagcagcctgaccagcgtgaagaccagcctgagaagcagcctgaacgaccccctgtgcctggtgcaccccagcagcgagacctgcaacagcatcagactgagcctgagccagctgaacagcaaccccgagctgagacagctgccccccgtggacgccgagctggacaacgtgaacaacgtgctgagaaccgacctggacggcctggtgcagcagggctaccagagcctgaacgacatccccgacagagtgcagagacagaccaccaccgtggtggccggcatcaagagagtgctgaacagcatcggcagcgacatcgacaacgtgacccagagactgcccatccaggacatcctgagcgccttcagcgtgtacgtgaacaacaccgagagctacatccacagaaacctgcccaccctggaggagtacgacagctactggtggctgggcggcctggtgatctgcagcctgctgaccctgatcgtgatcttctactacctgggcctgctgtgcggcgtgtgcggctacgacagacacgccacccccaccaccagaggctgcgtgagcaacaccggcggcgtgttcctgatggtgggcgtgggcctgagcttcctgttctgctggatcctgatgatcatcgtggtgctgaccttcgtgttcggcgccaacgtggagaagctgatctgcgagccctacaccagcaaggagctgttcagagtgctggacaccccctacctgctgaacgaggactgggagtactacctgagcggcaagctgttcaacaagagcaagatgaagctgaccttcgagcaggtgtacagcgactgcaagaagaacagaggcacctacggcaccctgcacctgcagaacagcttcaacatcagcgagcacctgaacatcaacgagcacaccggcagcatcagcagcgagctggagagcctgaaggtgaacctgaacatcttcctgctgggcgccgccggcagaaagaacctgcaggacttcgccgcctgcggcatcgacagaatgaactacgacagctacctggcccagaccggcaagagccccgccggcgtgaacctgctgagcttcgcctacgacctggaggccaaggccaacagcctgccccccggcaacctgagaaacagcctgaagagagacgcccagaccatcaagaccatccaccagcagagagtgctgcccatcgagcagagcctgagcaccctgtaccagagcgtgaagatcctgcagagaaccggcaacggcctgctggagagagtgaccagaatcctggccagcctggacttcgcccagaacttcatcaccaacaacaccagcagcgtgatcatcgaggagaccaagaagtacggcagaaccatcatcggctacttcgagcactacctgcagtggatcgagttcagcatcagcgagaaggtggccagctgcaagcccgtggccaccgccctggacaccgccgtggacgtgttcctgtgcagctacatcatcgaccccctgaacctgttctggttcggcatcggcaaggccaccgtgttcctgctgcccgccctgatcttcgccgtgaagctggccaagtactacagaagaatggacagcgaggacgtgtacgacgacgtggagaccatccccatgaagaacatggagaacggcaacaacggctaccacaaggaccacgtgtacggcatccacaaccccgtgatgaccagccccagccagcactag

SEQ ID NO: 94735 - DNA, 2571 bp, Artificial Sequence; identical to SEQ ID NO: 94734
  Description of Artificial Sequence: Synthetic coding sequence

SEQ ID NO: 94736 - DNA, 177 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctgtag

SEQ ID NO: 94737 - DNA, 123 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactag

SEQ ID NO: 94738 - DNA, 2598 bp, Artificial Sequence; identical to SEQ ID NO: 94733
  Description of Artificial Sequence: Synthetic coding sequence

SEQ ID NO: 94739 - DNA, 45 bp, Artificial Sequence
  Description of Artificial Sequence: Synthetic coding sequence
atggccctggtgctgggcagcctgctgctgctgggcctgtgctag

SEQ ID NO: 94740 - DNA, 2505 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctggtgcacatcttcctgtacgtggtgcagcccagagacttccccgaggacaccctgagaaagttcctgcagaaggcctacgagagcaagatcgactacgacaagcccgagaccgtgatcctgggcctgaagatcgtgtactacgaggccggcatcatcctgtgctgcgtgctgggcctgctgttcatcatcctgatgcccctggtgggctacttcttctgcatgtgcagatgctgcaacaagtgcggcggcgagatgcaccagagacagaaggagaacggccccttcctgagaaagtgcttcgccatcagcctgctggtgatctgcatcatcatcagcatcggcatcttctacggcttcgtggccaaccaccaggtgagaaccagaatcaagagaagcagaaagctggccgacagcaacttcaaggacctgagaaccctgctgaacgagacccccgagcagatcaagtacatcctggcccagtacaacaccaccaaggacaaggccttcaccgacctgaacagcatcaacagcgtgctgggcggcggcatcctggacagactgagacccaacatcatccccgtgctggacgagatcaagagcatggccaccgccatcaaggagaccaaggaggccctggagaacatgaacagcaccctgaagagcctgcaccagcagagcacccagctgagcagcagcctgaccagcgtgaagaccagcctgagaagcagcctgaacgaccccctgtgcctggtgcaccccagcagcgagacctgcaacagcatcagactgagcctgagccagctgaacagcaaccccgagctgagacagctgccccccgtggacgccgagctggacaacgtgaacaacgtgctgagaaccgacctggacggcctggtgcagcagggctaccagagcctgaacgacatccccgacagagtgcagagacagaccaccaccgtggtggccggcatcaagagagtgctgaacagcatcggcagcgacatcgacaacgtgacccagagactgcccatccaggacatcctgagcgccttcagcgtgtacgtgaacaacaccgagagctacatccacagaaacctgcccaccctggaggagtacgacagctactggtggctgggcggcctggtgatctgcagcctgctgaccctgatcgtgatcttctactacctgggcctgctgtgcggcgtgtgcggctacgacagacacgccacccccaccaccagaggctgcgtgagcaacaccggcggcgtgttcctgatggtgggcgtgggcctgagcttcctgttctgctggatcctgatgatcatcgtggtgctgaccttcgtgttcggcgccaacgtggagaagctgatctgcgagccctacaccagcaaggagctgttcagagtgctggacaccccctacctgctgaacgaggactgggagtactacctgagcggcaagctgttcaacaagagcaagatgaagctgaccttcgagcaggtgtacagcgactgcaagaagaacagaggcacctacggcaccctgcacctgcagaacagcttcaacatcagcgagcacctgaacatcaacgagcacaccggcagcatcagcagcgagctggagagcctgaaggtgaacctgaacatcttcctgctgggcgccgccggcagaaagaacctgcaggacttcgccgcctgcggcatcgacagaatgaactacgacagctacctggcccagaccggcaagagccccgccggcgtgaacctgctgagcttcgcctacgacctggaggccaaggccaacagcctgccccccggcaacctgagaaacagcctgaagagagacgcccagaccatcaagaccatccaccagcagagagtgctgcccatcgagcagagcctgagcaccctgtaccagagcgtgaagatcctgcagagaaccggcaacggcctgctggagagagtgaccagaatcctggccagcctggacttcgcccagaacttcatcaccaacaacaccagcagcgtgatcatcgaggagaccaagaagtacggcagaaccatcatcggctacttcgagcactacctgcagtggatcgagttcagcatcagcgagaaggtggccagctgcaagcccgtggccaccgccctggacaccgccgtggacgtgttcctgtgcagctacatcatcgaccccctgaacctgttctggttcggcatcggcaaggccaccgtgttcctgctgcccgccctgatcttcgccgtgaagctggccaagtactacagaagaatggacagcgaggacgtgtacgacgaccccagccagcactag

SEQ ID NO: 94741 - DNA, 2529 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctggtgcacatcttcctgtacgtggtgcagcccagagacttccccgaggacaccctgagaaagttcctgcagaaggcctacgagagcaagatcgactacgacaagcccgagaccgtgatcctgggcctgaagatcgtgtactacgaggccggcatcatcctgtgctgcgtgctgggcctgctgttcatcatcctgatgcccctggtgggctacttcttctgcatgtgcagatgctgcaacaagtgcggcggcgagatgcaccagagacagaaggagaacggccccttcctgagaaagtgcttcgccatcagcctgctggtgatctgcatcatcatcagcatcggcatcttctacggcttcgtggccaaccaccaggtgagaaccagaatcaagagaagcagaaagctggccgacagcaacttcaaggacctgagaaccctgctgaacgagacccccgagcagatcaagtacatcctggcccagtacaacaccaccaaggacaaggccttcaccgacctgaacagcatcaacagcgtgctgggcggcggcatcctggacagactgagacccaacatcatccccgtgctggacgagatcaagagcatggccaccgccatcaaggagaccaaggaggccctggagaacatgaacagcaccctgaagagcctgcaccagcagagcacccagctgagcagcagcctgaccagcgtgaagaccagcctgagaagcagcctgaacgaccccctgtgcctggtgcaccccagcagcgagacctgcaacagcatcagactgagcctgagccagctgaacagcaaccccgagctgagacagctgccccccgtggacgccgagctggacaacgtgaacaacgtgctgagaaccgacctggacggcctggtgcagcagggctaccagagcctgaacgacatccccgacagagtgcagagacagaccaccaccgtggtggccggcatcaagagagtgctgaacagcatcggcagcgacatcgacaacgtgacccagagactgcccatccaggacatcctgagcgccttcagcgtgtacgtgaacaacaccgagagctacatccacagaaacctgcccaccctggaggagtacgacagctactggtggctgggcggcctggtgatctgcagcctgctgaccctgatcgtgatcttctactacctgggcctgctgtgcggcgtgtgcggctacgacagacacgccacccccaccaccagaggctgcgtgagcaacaccggcggcgtgttcctgatggtgggcgtgggcctgagcttcctgttctgctggatcctgatgatcatcgtggtgctgaccttcgtgttcggcgccaacgtggagaagctgatctgcgagccctacaccagcaaggagctgttcagagtgctggacaccccctacctgctgaacgaggactgggagtactacctgagcggcaagctgttcaacaagagcaagatgaagctgaccttcgagcaggtgtacagcgactgcaagaagaacagaggcacctacggcaccctgcacctgcagaacagcttcaacatcagcgagcacctgaacatcaacgagcacaccggcagcatcagcagcgagctggagagcctgaaggtgaacctgaacatcttcctgctgggcgccgccggcagaaagaacctgcaggacttcgccgcctgcggcatcgacagaatgaactacgacagctacctggcccagaccggcaagagccccgccggcgtgaacctgctgagcttcgcctacgacctggaggccaaggccaacagcctgccccccggcaacctgagaaacagcctgaagagagacgcccagaccatcaagaccatccaccagcagagagtgctgcccatcgagcagagcctgagcaccctgtaccagagcgtgaagatcctgcagagaaccggcaacggcctgctggagagagtgaccagaatcctggccagcctggacttcgcccagaacttcatcaccaacaacaccagcagcgtgatcatcgaggagaccaagaagtacggcagaaccatcatcggctacttcgagcactacctgcagtggatcgagttcagcatcagcgagaaggtggccagctgcaagcccgtggccaccgccctggacaccgccgtggacgtgttcctgtgcagctacatcatcgaccccctgaacctgttctggttcggcatcggcaaggccaccgtgttcctgctgcccgccctgatcttcgccgtgaagctggccaagtactacagaagaatggacagcgaggacgtgtacgacgacgtggagaccatccccatgaagaaccccagccagcactag

SEQ ID NO: 94742 - DNA, 2493 bp, Artificial Sequence
  Description of Artificial Sequence: Synthetic coding sequence
atggccctggtgctgggcagcctgctgctgctgggcctgtgcggcaacagcttcagcggcggccagcccagcagcaccgacgcccccaaggcctggaactacgagctgcccgccaccaactacgagacccaggacagccacaaggccggccccatcggcatcctgttcgagctggtgcacatcttcctgtacgtggtgcagcccagagacttccccgaggacaccctgagaaagttcctgcagaaggcctacgagagcaagatcgactacgacaagatcgtgtactacgaggccggcatcatcctgtgctgcgtgctgggcctgctgttcatcatcctgatgcccctggtgggctacttcttctgcatgtgcagatgctgcaacaagtgcggcggcgagatgcaccagagacagaaggagaacggccccttcctgagaaagtgcttcgccatcagcctgctggtgatctgcatcatcatcagcatcggcatcttctacggcttcgtggccaaccaccaggtgagaaccagaatcaagagaagcagaaagctggccgacagcaacttcaaggacctgagaaccctgctgaacgagacccccgagcagatcaagtacatcctggcccagtacaacaccaccaaggacaaggccttcaccgacctgaacagcatcaacagcgtgctgggcggcggcatcctggacagactgagacccaacatcatccccgtgctggacgagatcaagagcatggccaccgccatcaaggagaccaaggaggccctggagaacatgaacagcaccctgaagagcctgcaccagcagagcacccagctgagcagcagcctgaccagcgtgaagaccagcctgagaagcagcctgaacgaccccctgtgcctggtgcaccccagcagcgagacctgcaacagcatcagactgagcctgagccagctgaacagcaaccccgagctgagacagctgccccccgtggacgccgagctggacaacgtgaacaacgtgctgagaaccgacctggacggcctggtgcagcagggctaccagagcctgaacgacatccccgacagagtgcagagacagaccaccaccgtggtggccggcatcaagagagtgctgaacagcatcggcagcgacatcgacaacgtgacccagagactgcccatccaggacatcctgagcgccttcagcgtgtacgtgaacaacaccgagagctacatccacagaaacctgcccaccctggaggagtacgacagctactggtggctgggcggcctggtgatctgcagcctgctgaccctgatcgtgatcttctactacctgggcctgctgtgcggcgtgtgcggctacgacagacacgccacccccaccaccagaggctgcgtgagcaacaccggcggcgtgttcctgatggtgggcgtgggcctgagcttcctgttctgctggatcctgatgatcatcgtggtgctgaccttcgtgttcggcgccaacgtggagaagctgatctgcgagccctacaccagcaaggagctgttcagagtgctggacaccccctacctgctgaacgaggactgggagtactacctgagcggcaagctgttcaacaagagcaagatgaagctgaccttcgagcaggtgtacagcgactgcaagaagaacagaggcacctacggcaccctgcacctgcagaacagcttcaacatcagcgagcacctgaacatcaacgagcacaccggcagcatcagcagcgagctggagagcctgaaggtgaacctgaacatcttcctgctgggcgccgccggcagaaagaacctgcaggacttcgccgcctgcggcatcgacagaatgaactacgacagctacctggcccagaccggcaagagccccgccggcgtgaacctgctgagcttcgcctacgacctggaggccaaggccaacagcctgccccccggcaacctgagaaacagcctgaagagagacgcccagaccatcaagaccatccaccagcagagagtgctgcccatcgagcagagcctgagcaccctgtaccagagcgtgaagatcctgcagagaaccggcaacggcctgctggagagagtgaccagaatcctggccagcctggacttcgcccagaacttcatcaccaacaacaccagcagcgtgatcatcgaggagaccaagaagtacggcagaaccatcatcggctacttcgagcactacctgcagtggatcgagttcagcatcagcgagaaggtggccagctgcaagcccgtggccaccgccctggacaccgccgtggacgtgttcctgtgcagctacatcatcgaccccctgaacctgttctggttcggcatcggcaaggccaccgtgttcctgctgcccgccctgatcttcgccgtgaagctggccaagtactacagaagaatggacagcgaggacgtgtacgacgacagcagctgggtgaccagcgtgcagtgctag

SEQ ID NO: 94743 - DNA, 681 bp, Artificial Sequence
  Description of Artificial Sequence: Synthetic coding sequence
atggaggccgagagaagaagacaggccgagaagcccaagaagggcagagtgggcagcaacctgctgcccgagagacaccccgccaccggcacccccaccaccaccgtggacagcagcgcccccccctgcagaagactgcccggcgccggcggcggcagaagcagattcagcccccagggcggccagagaggcagaccccacagcagaagaagacacagaaccaccttcagccccgtgcagctggagcagctggagagcgccttcggcagaaaccagtaccccgacatctgggccagagagagcctggccagagacaccggcctgagcgaggccagaatccaggtgtggttccagaacagaagagccaagcagagaaagcaggagagaagcctgctgcagcccctggcccacctgagccccgccgccttcagcagcttcctgcccgagagcaccgcctgcccctacagctacgccgccccccccccccccgtgacctgcttcccccacccctacagccacgccctgcccagccagcccagcaccggcggcgccttcgccctgagccaccagagcgaggactggtaccccaccctgcaccccgcccccgccggccacctgccctgccccccccccccccccatgctgcccctgagcctggagcccagcaagagctggaactag

SEQ ID NO: 94744 - DNA, 417 bp, Artificial Sequence
  Description of Artificial Sequence: Synthetic coding sequence
aacatcagcctgtgccccgagatctgcttccagaagatcgagagccaggtgtacttcgtgagagtggacagcggcatccagcccggcagcgacatcagcatctactacgaccccatgatcagcaagctgatcacctacggcagcgacagaaccgaggccctgaagagaatggccgacgccctggacaactacgtgatcagaggcgtgacccacaacatcgccctgctgagagaggtgatcatcaacagcagattcgtgaagggcgacatcagcaccaagttcctgagcgacgtgtaccccgacggcttcaagggccacatgctgaccaagagcgagaagaaccagctgctggccatcgccagcagcctgttcgtggccttccagctgagagcccagcacttccaggagaacagctag

SEQ ID NO: 94745 - DNA, 363 bp, Artificial Sequence
  Description of Artificial Sequence: Synthetic coding sequence
atgagcatccagttcctgggcaccgtgtacaaggtgaacatcctgaccagactggccgccgagctgaacaagttcatgctggagaaggtgaccgaggacaccagcagcgtgctgagaagccccatgcccggcgtggtggtggccgtgagcgtgaagcccggcgacgccgccaccagcagcctgagcgtggagatctgcctgttctggaccttccaggtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94746 - DNA, 2046 bp, Artificial Sequence
  Description of Artificial Sequence: Synthetic coding sequence
atggccggcttctgggtgggcaccgcccccctggtggccgccggcagaagaggcagatggcccccccagcagctgatgctgagcgccgccctgagaaccctgaagcacgtgctgtactacagcagacagtgcctgatggtgagcagaaacctgggcagcgtgggctacgaccccaacgagaagaccttcgacaagatcctggtggccaacagaggcgagatcgcctgcagagtgatcagaacctgcaagaagatgggcatcaagaccgtggccatccacagcgacgtggacgccagcagcgtgcacgtgaagatggccgacgaggccgtgtgcgtgggccccgcccccaccagcaagagctacctgaacatggacgccatcatggaggccatcaagaagaccagagcccaggccgtgcaccccggctacggcttcctgagcgagaacaaggagttcgccagatgcctggccgccgaggacgtggtgttcatcggccccgacacccacgccatccaggccatgggcgacaagatcgagagcaagctgctggccaagaaggccgaggtgaacaccatccccggcttcgacggcgtggtgaaggacgccgaggaggccgtgagaatcgccagagagatcggctaccccgtgatgatcaaggccagcgccggcggcggcggcaagggcatgagaatcgcctgggacgacgaggagaccagagacggcttcagactgagcagccaggaggccgccagcagcttcggcgacgacagactgctgatcgagaagttcatcgacaaccccagacacatcgagatccaggtgctgggcgacaagcacggcaacgccctgtggctgaacgagagagagtgcagcatccagagaagaaaccagaaggtggtggaggaggcccccagcatcttcctggacgccgagaccagaagagccatgggcgagcaggccgtggccctggccagagccgtgaagtacagcagcgccggcaccgtggagttcctggtggacagcaagaagaacttctacttcctggagatgaacaccagactgcaggtggagcaccccgtgaccgagtgcatcaccggcctggacctggtgcaggagatgatcagagtggccaagggctaccccctgagacacaagcaggccgacatcagaatcaacggctgggccgtggagtgcagagtgtacgccgaggacccctacaagagcttcggcctgcccagcatcggcagactgagccagtaccaggagcccctgcacctgcccggcgtgagagtggacagcggcatccagcccggcagcgacatcagcatctactacgaccccatgatcagcaagctgatcacctacggcagcgacagaaccgaggccctgaagagaatggccgacgccctggacaactacgtgatcagaggcgtgacccacaacatcgccctgctgagagaggtgatcatcaacagcagattcgtgaagggcgacatcagcaccaagttcctgagcgacgtgtaccccgacggcttcaagggccacatgctgaccaagagcgagaagaaccagctgctggccatcgccagcagcctgttcgtggccttccagctgagagcccagcacttccaggagaacagcagaatgcccgtgatcaagcccgacatcgccaactgggagctgagcgtgaagctgcacgacaaggtgcacaccgtggtggccagcaacaacggcagcgtgttcagcgtggaggtggacggcagcaagctgaacgtgaccagcacctggaacctggccagccccctgctgagcgtgagcgtggacggcacccagagaaccgtgcagtgcctgagcagagaggccggcggcaacatgagcatccagttcctgggcaccgtggtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94747 - DNA, 2187 bp, Artificial Sequence
  Description of Artificial Sequence: Synthetic coding sequence
atggccggcttctgggtgggcaccgcccccctggtggccgccggcagaagaggcagatggcccccccagcagctgatgctgagcgccgccctgagaaccctgaagcacgtgctgtactacagcagacagtgcctgatggtgagcagaaacctgggcagcgtgggctacgaccccaacgagaagaccttcgacaagatcctggtggccaacagaggcgagatcgcctgcagagtgatcagaacctgcaagaagatgggcatcaagaccgtggccatccacagcgacgtggacgccagcagcgtgcacgtgaagatggccgacgaggccgtgtgcgtgggccccgcccccaccagcaagagctacctgaacatggacgccatcatggaggccatcaagaagaccagagcccaggccgtgcaccccggctacggcttcctgagcgagaacaaggagttcgccagatgcctggccgccgaggacgtggtgttcatcggccccgacacccacgccatccaggccatgggcgacaagatcgagagcaagctgctggccaagaaggccgaggtgaacaccatccccggcttcgacggcgtggtgaaggacgccgaggaggccgtgagaatcgccagagagatcggctaccccgtgatgatcaaggccagcgccggcggcggcggcaagggcatgagaatcgcctgggacgacgaggagaccagagacggcttcagactgagcagccaggaggccgccagcagcttcggcgacgacagactgctgatcgagaagttcatcgacaaccccagacacatcgagatccaggtgctgggcgacaagcacggcaacgccctgtggctgaacgagagagagtgcagcatccagagaagaaaccagaaggtggtggaggaggcccccagcatcttcctggacgccgagaccagaagagccatgggcgagcaggccgtggccctggccagagccgtgaagtacagcagcgccggcaccgtggagttcctggtggacagcaagaagaacttctacttcctggagatgaacaccagactgcaggtggagcaccccgtgaccgagtgcatcaccggcctggacctggtgcaggagatgatcagagtggccaagggctaccccctgagacacaagcaggccgacatcagaatcaacggctgggccgtggagtgcagagtgtacgccgaggacccctacaagagcttcggcctgcccagcatcggcagactgagccagtaccaggagcccctgcacctgcccggcgtgagagtggacagcggcatccagcccggcagcgacatcagcatctactacgaccccatgatcagcaagctgatcacctacggcagcgacagaaccgaggccctgaagagaatggccgacgccctggacaactacgtgatcagaggcgtgacccacaacatcgccctgctgagagaggtgatcatcaacagcagattcgtgaagggcgacatcagcaccaagttcctgagcgacgtgtaccccgacggcttcaagggccacatgctgaccaagagcgagaagaaccagctgctggccatcgccagcagcctgttcgtggccttccagctgagagcccagcacttccaggagaacagcagaatgcccgtgatcaagcccgacatcgccaactgggagctgagcgtgaagctgcacgacaaggtgcacaccgtggtggccagcaacaacggcagcgtgttcagcgtggaggtggacggcagcaagctgaacgtgaccagcacctggaacctggccagccccctgctgagcgtgagcgtggacggcacccagagaaccgtgcagtgcctgagcagagaggccggcggcaacatgagcatccagttcctgggcaccgtgtacaaggtgaacatcctgaccagactggccgccgagctgaacaagttcatgctggagaaggtgaccgaggacaccagcagcgtgctgagaagccccatgcccggcgtggtggtggccgtgagcgtgaagcccggcgacgccgtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94748 - DNA, 2109 bp, Artificial Sequence
  Description of Artificial Sequence: Synthetic coding sequence
atggccggcttctgggtgggcaccgcccccctggtggccgccggcagaagaggcagatggcccccccagcagctgatgctgagcgccgccctgagaaccctgaagaccttcgacaagatcctggtggccaacagaggcgagatcgcctgcagagtgatcagaacctgcaagaagatgggcatcaagaccgtggccatccacagcgacgtggacgccagcagcgtgcacgtgaagatggccgacgaggccgtgtgcgtgggccccgcccccaccagcaagagctacctgaacatggacgccatcatggaggccatcaagaagaccagagcccaggccgtgcaccccggctacggcttcctgagcgagaacaaggagttcgccagatgcctggccgccgaggacgtggtgttcatcggccccgacacccacgccatccaggccatgggcgacaagatcgagagcaagctgctggccaagaaggccgaggtgaacaccatccccggcttcgacggcgtggtgaaggacgccgaggaggccgtgagaatcgccagagagatcggctaccccgtgatgatcaaggccagcgccggcggcggcggcaagggcatgagaatcgcctgggacgacgaggagaccagagacggcttcagactgagcagccaggaggccgccagcagcttcggcgacgacagactgctgatcgagaagttcatcgacaaccccagacacatcgagatccaggtgctgggcgacaagcacggcaacgccctgtggctgaacgagagagagtgcagcatccagagaagaaaccagaaggtggtggaggaggcccccagcatcttcctggacgccgagaccagaagagccatgggcgagcaggccgtggccctggccagagccgtgaagtacagcagcgccggcaccgtggagttcctggtggacagcaagaagaacttctacttcctggagatgaacaccagactgcaggtggagcaccccgtgaccgagtgcatcaccggcctggacctggtgcaggagatgatcagagtggccaagggctaccccctgagacacaagcaggccgacatcagaatcaacggctgggccgtggagtgcagagtgtacgccgaggacccctacaagagcttcggcctgcccagcatcggcagactgagccagtaccaggagcccctgcacctgcccggcgtgagagtggacagcggcatccagcccggcagcgacatcagcatctactacgaccccatgatcagcaagctgatcacctacggcagcgacagaaccgaggccctgaagagaatggccgacgccctggacaactacgtgatcagaggcgtgacccacaacatcgccctgctgagagaggtgatcatcaacagcagattcgtgaagggcgacatcagcaccaagttcctgagcgacgtgtaccccgacggcttcaagggccacatgctgaccaagagcgagaagaaccagctgctggccatcgccagcagcctgttcgtggccttccagctgagagcccagcacttccaggagaacagcagaatgcccgtgatcaagcccgacatcgccaactgggagctgagcgtgaagctgcacgacaaggtgcacaccgtggtggccagcaacaacggcagcgtgttcagcgtggaggtggacggcagcaagctgaacgtgaccagcacctggaacctggccagccccctgctgagcgtgagcgtggacggcacccagagaaccgtgcagtgcctgagcagagaggccggcggcaacatgagcatccagttcctgggcaccgtgtacaaggtgaacatcctgaccagactggccgccgagctgaacaagttcatgctggagaaggtgaccgaggacaccagcagcgtgctgagaagccccatgcccggcgtggtggtggccgtgagcgtgaagcccggcgacgccgtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94749 - DNA, 255 bp, Artificial Sequence
  Description of Artificial Sequence: Synthetic coding sequence
tgaaactgggagctgagcgtgaagctgcacgacaaggtgcacaccgtggtggccagcaacaacggcagcgtgttcagcgtggaggtggacggcagcaagctgaacgtgaccagcacctggaacctggccagccccctgctgagcgtgagcgtggacggcacccagagaaccgtgcagtgcctgagcagagaggccggcggcaacatgagcatccagttcctgggcaccgtgccctggagaaagctgctggactag

SEQ ID NO: 94750 - DNA, 336 bp, Artificial Sequence
  Description of Artificial Sequence: Synthetic coding sequence
tacaaggtgaacatcctgaccagactggccgccgagctgaacaagttcatgctggagaaggtgaccgaggacaccagcagcgtgctgagaagccccatgcccggcgtggtggtggccgtgagcgtgaagcccggcgacgccgccaccagcagcctgagcgtggagatctgcctgttctggaccttccaggtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94751 - DNA, 405 bp, Artificial Sequence
  Description of Artificial Sequence: Synthetic coding sequence
tgaatgcccgtgatcaagcccgacatcgccaactgggagctgagcgtgaagctgcacgacaaggtgcacaccgtggtggccagcaacaacggcagcgtgttcagcgtggaggtggacggcagcaagctgaacgtgaccagcacctggaacctggccagccccctgctgagcgtgagcgtggacggcacccagagaaccgtgcagtgcctgagcagagaggccggcggcaacatgagcatccagttcctgggcaccgtggtggccgagggccaggagatctgcgtgatcgaggccatgaagatgcagaacagcatgaccgccggcaagaccggcaccgtgaagagcgtgcactgccaggccggcgacaccgtgggcgagggcgacctgctggtggagctggagtag

SEQ ID NO: 94752 - DNA, 309 bp, Artificial Sequence
  Description of Artificial Sequence: Synthetic coding sequence
agcgacgtgtaccccgacggcttcaagggccacatgctgaccaagagcgagaagaaccagctgctggccatcgccagcagcctgttcgtggccttccagctgagagcccagcacttccaggagaacagcagaatgcccgtgatcaagcccgacatcgccaactgggagctgagcgtgaagctgcacgacaaggtgcacaccgtggtggccagcaacaacggcagcgtgttcagcgtggaggtggacggcagcaagctgaacgtgaccagcacctggaacctgttcgccctgatcgtgtgccagagatag

SEQ ID NO: 94753 - DNA, 1620 bp, Artificial Sequence
  Description of Artificial Sequence: Synthetic coding sequence
atggccgccgccctgagagtggccgccgtgggcgccagactgagcgtgctggccagcggcctgagagccgccgtgagaagcctgtgcagccaggccaccagcgtgaacgagagaatcgagaacaagagaagaaccgccctgctgggcggcggccagagaagaatcgacgcccagcacaagagaggcaagctgaccgccagagagagaatcagcctgctgctggaccccggcagcttcgtggagagcgacatgttcgtggagcacagatgcgccgacttcggcatggccgccgacaagaacaagttccccggcgacagcgtggtgaccggcagaggcagaatcaacggcagactggtgtacgtgttcagccaggacttcaccgtgttcggcggcagcctgagcggcgcccacgcccagaagatctgcaagatcatggaccaggccatcaccgtgggcgcccccgtgatcggcctgaacgacagcggcggcgccagaatccaggagggcgtggagagcctggccggctacgccgacatcttcctgagaaacgtgaccgccagcggcgtgatcccccagatcagcctgatcatgggcccctgcgccggcggcgccgtgtacagccccgccctgaccgacttcaccttcatggtgaaggacaccagctacctgttcatcaccggccccgacgtggtgaagagcgtgaccaacgaggacgtgacccaggaggagctgggcggcgccaagacccacaccaccatgagcggcgtggcccacagagccttcgagaacgacgtggacgccctgtgcaacctgagagacttcttcaactacctgcccctgagcagccaggaccccgcccccgtgagagagtgccacgaccccagcgacagactggtgcccgagctggacaccatcgtgcccctggagagcaccaaggcctacaacatggtggacatcatccacagcgtggtggacgagagagagttcttcgagatcatgcccaactacgccaagaacatcatcgtgggcttcgccagaatgaacggcagaaccgtgggcatcgtgggcaaccagcccaaggtggccagcggctgcctggacatcaacagcagcgtgaagggcgccagattcgtgagattctgcgacgccttcaacatccccctgatcaccttcgtggacgtgcccggcttcctgcccggcaccgcccaggagtacggcggcatcatcagacacggcgccaagctgctgtacgccttcgccgaggccaccgtgcccaaggtgaccgtgatcaccagaaaggcctacggcggcgcctacgacgtgatgagcagcaagcacctgtgcggcgacaccaactacgcctggcccaccgccgagatcgccgtgatgggcgccaagggcgccgtggagatcatcttcaagggccacgagaacgtggaggccgcccaggccgagtacatcgagaagttcgccaaccccttccccgccgccgtgagaggcttcgtggacgacatcatccagcccagcagcaccagagccagaatctgctgcgacctggacgtgctggccagcaagaaggtgcagagaccctggagaaagcacgccaacatccccctgtag

SEQ ID NO: 94754 - DNA, 1680 bp, Artificial Sequence
  Description of Artificial Sequence: Synthetic coding sequence
atggccgccgccctgagagtggccgccgtgggcgccagactgagcgtgctggccagcggcctgagagccgccgtgagaagcctgtgcagccaggccaccagcgtgaacgagagaatcgagaacaagagaagaaccgccctgctgggcggcggccagagaagaatcgacgcccagcacaagagaggcaagctgaccgccagagagagaatcagcctgctgctggaccccggcagcttcgtggagagcgacatgttcgtggagcacagatgcgccgacttcggcatggccgccgacaagaacaagttccccggcgacagcgtggtgaccggcagaggcagaatcaacggcagactggtgtacgtgttcagccagcagatcatcggctgggcccagtggctgcccctggtgatcagcgccctgtgggaggccgaggacttcaccgtgttcggcggcagcctgagcggcgcccacgcccagaagatctgcaagatcatggaccaggccatcaccgtgggcgcccccgtgatcggcctgaacgacagcggcggcgccagaatccaggagggcgtggagagcctggccggctacgccgacatcttcctgagaaacgtgaccgccagcggcgtgatcccccagatcagcctgatcatgggcccctgcgccggcggcgccgtgtacagccccgccctgaccgacttcaccttcatggtgaaggacaccagctacctgttcatcaccggccccgacgtggtgaagagcgtgaccaacgaggacgtgacccaggaggagctgggcggcgccaagacccacaccaccatgagcggcgtggcccacagagccttcgagaacgacgtggacgccctgtgcaacctgagagacttcttcaactacctgcccctgagcagccaggaccccgcccccgtgagagagtgccacgaccccagcgacagactggtgcccgagctggacaccatcgtgcccctggagagcaccaaggcctacaacatggtggacatcatccacagcgtggtggacgagagagagttcttcgagatcatgcccaactacgccaagaacatcatcgtgggcttcgccagaatgaacggcagaaccgtgggcatcgtgggcaaccagcccaaggtggccagcggctgcctggacatcaacagcagcgtgaagggcgccagattcgtgagattctgcgacgccttcaacatccccctgatcaccttcgtggacgtgcccggcttcctgcccggcaccgcccaggagtacggcggcatcatcagacacggcgccaagctgctgtacgccttcgccgaggccaccgtgcccaaggtgaccgtgatcaccagaaaggcctacggcggcgcctacgacgtgatgagcagcaagcacctgtgcggcgacaccaactacgcctggcccaccgccgagatcgccgtgatgggcgccaagggcgccgtggagatcatcttcaagggccacgagaacgtggaggccgcccaggccgagtacatcgagaagttcgccaaccccttccccgccgccgtgagaggcttcgtggacgacatcatccagcccagcagcaccagagccagaatctgctgcgacctggacgtgctggccagcaagaaggtgcagagaccctggagaaagcacgccaacatccccctgtag

SEQ ID NO: 94755 - DNA, 1653 bp, Artificial Sequence
  Description of Artificial Sequence: Synthetic coding sequence
atggccgccgccctgagagtggccgccgtgggcgccagactgagcgtgctggccagcggcctgagagccgccgtgagaagcctgtgcagccaggccaccagcgtgaacgagagaatcgagaacaagagaagaaccgccctgctgggcggcggccagagaagaatcgacgcccagcacaagagaggcaagctgaccgccagagagagaatcagcctgctgctggaccccggcagcttcgtggagagcgacatgttcgtggagcacagatgcgccgacttcggcatggccgccgacaagaacaagttccccggcgacagcgtggtgaccggcagaggcagaatcaacggcagactggtgtacgtgttcagccaggacttcaccgtgttcggcggcagcctgagcggcgcccacgcccagaagatctgcaagatcatggaccaggccatcaccgtgggcgcccccgtgatcggcctgaacgacagcggcggcgccagaatccaggagggcgtggagagcctggccggctacgccgacatcttcctgagaaacgtgaccgccagcggcgtgatcccccagatcagcctgatcatgggcccctgcgccggcggcgccgtgtacagccccgccctgaccgacttcaccttcatggtgaaggacaccagctacctgttcatcaccggccccgacgtggtgaagagcgtgaccaacgaggacgtgacccaggaggagctgggcggcgccaagacccacaccaccatgagcggcgtggcccacagagccttcgagaacgacgtggacgccctgtgcaacctgagagacttcttcaactacctgcccctgagcagccaggaccccgcccccgtgagagagtgccacgaccccagcgacagactggtgcccgagctggacaccatcgtgcccctggagagcaccaaggcctacaacatggtggacatcatccacagcgtggtggacgagagagagttcttcgagatcatgcccaactacgccaagaacatcatcgtgggcttcgccagaatgaacggcagaaccgtgggcatcgtgggcaaccagcccaaggtggccagcggctgcctggacatcaacagcagcgtgaagggcgccagattcgtgagattctgcgacgccttcaacatccccctgatcaccttcgtggacgtgcccggcttcctgcccggcaccgcccaggagtacggcggcatcatcagacacggcgccaagctgctgtacgccttcgccgaggccaccgtgcccaaggtgaccgtgatcaccagaaaggcctacggcggcgcctacgacgtgatgagcagcaagcacctgtgcggcgacaccaactacgcctggcccaccgccgagatcgccgtgatgggcgccaagggcgccgtggagatcatcttcaagggccacgagaacgtggaggccgcccaggccgagtacatcgagaagttcgccaaccccttccccgccgccgtgagaggcttcgtggacgacatcatccagcccagcagcaccagagccagaatctgctgcgacctggacgtgctggccagcaagaaggtgagagtgcaggaggtgttccaccaggtggtgcagagcggccacagagacggcagaggcgccgtgagatggtag

SEQ ID NO: 94756 - DNA, 387 bp, Artificial Sequence
  Description of Artificial Sequence: Synthetic coding sequence
atgagcctgagactggacaccacccccagctgcaacagcgccagacccctgcacgccctgcaggtgctgctgctgctgagcctgctgctgaccgccctggccagcagcaccaagggccagaccaagagaaacctggccaagggcaaggaggagagcctggacagcgacctgtacgccgagctgagatgcatgtgcatcaagaccaccagcggcatccaccccaagaacatccagagcctggaggtgatcggcaagggcacccactgcaaccaggtggaggtgatcgccaccctgaaggacggcagaaagatctgcctggaccccgacgcccccagaatcaagaagatcgtgcagaagaagctggccggcgacgagagcgccgactag

SEQ ID NO: 94757 - DNA, 2262 bp, Artificial Sequence
  Description of Artificial Sequence: Synthetic coding sequence
atggagagaagagcctggagcctgcagtgcaccgccttcgtgctgttctgcgcctggtgcgccctgaacagcgccaaggccaagagacagttcgtgaacgagtgggccgccgagatccccggcggccccgaggccgccagcgccatcgccgaggagctgggctacgacctgctgggccagatcggcagcctggagaaccactacctgttcaagcacaagaaccaccccagaagaagcagaagaagcgccttccacatcaccaagagactgagcgacgacgacagagtgatctgggccgagcagcagtacgagaaggagagaagcaagagaagcgccctgagagacagcgccctgaacctgttcaacgaccccatgtggaaccagcagtggtacctgcaggacaccagaatgaccgccgccctgcccaagctggacctgcacgtgatccccgtgtggcagaagggcatcaccggcaagggcgtggtgatcaccgtgctggacgacggcctggagtggaaccacaccgacatctacgccaactacgaccccgaggccagctacgacttcaacgacaacgaccacgaccccttccccagatacgaccccaccaacgagaacaagcacggcaccagatgcgccggcgagatcgccatgcaggccaacaaccacaagtgcggcgtgggcgtggcctacaacagcaaggtgggcggcatcagaatgctggacggcatcgtgaccgacgccatcgaggccagcagcatcggcttcaaccccggccacgtggacatctacagcgccagctggggccccaacgacgacggcaagaccgtggagggccccggcagactggcccagaaggccttcgagtacggcgtgaagcagggcagacagggcaagggcagcatcttcgtgtgggccagcggcaacggcggcagacagggcgacaactgcgactgcgacggctacaccgacagcatctacaccatcagcatcagcagcgccagccagcagggcctgagcccctggtacgccgagaagtgcagcagcaccctggccaccagctacagcagcggcgactacaccgaccagagaatcaccagcgccgacctgcacaacgactgcaccgagacccacaccggcaccagcgccagcgcccccctggccgccggcatcttcgccctggccctggaggccaaccccaacctgacctggagagacatgcagcacctggtggtgtggaccagcgagtacgaccccctggccaacaaccccggctggaagaagaacggcgccggcctgatggtgaacagcagattcggcttcggcctgctgaacgccaaggccctggtggacctggccgaccccagaacctggagaagcgtgcccgagaagaaggagtgcgtggtgaaggacaacgacttcgagcccagagccctgaaggccaacggcgaggtgatcatcgagatccccaccagagcctgcgagggccaggagaacgccatcaagagcctggagcacgtgcagttcgaggccaccatcgagtacagcagaagaggcgacctgcacgtgaccctgaccagcgccgccggcaccagcaccgtgctgctggccgagagagagagagacaccagccccaacggcttcaagaactgggacttcatgagcgtgcacacctggggcgagaaccccatcggcacctggaccctgagaatcaccgacatgagcggcagaatccagaacgagggcagaatcgtgaactggaagctgatcctgcacggcaccagcagccagcccgagcacatgaagcagcccagagtgtacaccagctacaacaccgtgcagaacgacagaagaggcgtggagaagatggtggaccccggcgaggagcagcccacccaggagaaccccaaggagaacaccctggtgagcaagagccccagcagcagcagcgtgggcggcagaagagacgagctggaggagggcgcccccagccaggccatgctgagactgctgcagagcgccttcagcaagaacagcccccccaagcagagccccaagaagagccccagcgccaagctgaacatcccctacgagaacttctacgaggccctggagaagctgaacaagcccagccagctgaaggacagcgaggacagcctgtacaacgactacgtggacgtgttctacaacaccaagccctacaagcacagagacgacagactgctgcaggccctggtggacatcctgaacgaggagaactag

SEQ ID NO: 94758 - DNA, 477 bp, Artificial Sequence
  Description of Artificial Sequence: Synthetic coding sequence
atggagagaagagcctggagcctgcagtgcaccgccttcgtgctgttctgcgcctggtgcgccctgaacagcgccaaggccaagagacagttcgtgaacgagtgggccgccgagatccccggcggccccgaggccgccagcgccatcgccgaggagctgggctacgacctgctgggccagatcggcagcctggagaaccactacctgttcaagcacaagaaccaccccagaagaagcagaagaagcgccttccacatcaccaagagactgagcgacgacgacagagtgatctgggccgagcagcagtacgagaaggagagaagcaagagaagcgccctgagagacagcgccctgaacctgttcaacgaccccatgtggaaccagcagtggtacctgcaggacaccagaatgaccgccgccctgcccaagctggacctgcacgtgatccccgtgtggcagaagggcatcaccggctag

SEQ ID NO: 94759 - DNA, 2121 bp, Artificial Sequence
  Description of Artificial Sequence: Synthetic coding sequence
atgggcaagggcagcatcagcttcctgttcttcagccagatcggcagcctggagaaccactacctgttcaagcacaagaaccaccccagaagaagcagaagaagcgccttccacatcaccaagagactgagcgacgacgacagagtgatctgggccgagcagcagtacgagaaggagagaagcaagagaagcgccctgagagacagcgccctgaacctgttcaacgaccccatgtggaaccagcagtggtacctgcaggacaccagaatgaccgccgccctgcccaagctggacctgcacgtgatccccgtgtggcagaagggcatcaccggcaagggcgtggtgatcaccgtgctggacgacggcctggagtggaaccacaccgacatctacgccaactacgaccccgaggccagctacgacttcaacgacaacgaccacgaccccttccccagatacgaccccaccaacgagaacaagcacggcaccagatgcgccggcgagatcgccatgcaggccaacaaccacaagtgcggcgtgggcgtggcctacaacagcaaggtgggcggcatcagaatgctggacggcatcgtgaccgacgccatcgaggccagcagcatcggcttcaaccccggccacgtggacatctacagcgccagctggggccccaacgacgacggcaagaccgtggagggccccggcagactggcccagaaggccttcgagtacggcgtgaagcagggcagacagggcaagggcagcatcttcgtgtgggccagcggcaacggcggcagacagggcgacaactgcgactgcgacggctacaccgacagcatctacaccatcagcatcagcagcgccagccagcagggcctgagcccctggtacgccgagaagtgcagcagcaccctggccaccagctacagcagcggcgactacaccgaccagagaatcaccagcgccgacctgcacaacgactgcaccgagacccacaccggcaccagcgccagcgcccccctggccgccggcatcttcgccctggccctggaggccaaccccaacctgacctggagagacatgcagcacctggtggtgtggaccagcgagtacgaccccctggccaacaaccccggctggaagaagaacggcgccggcctgatggtgaacagcagattcggcttcggcctgctgaacgccaaggccctggtggacctggccgaccccagaacctggagaagcgtgcccgagaagaaggagtgcgtggtgaaggacaacgacttcgagcccagagccctgaaggccaacggcgaggtgatcatcgagatccccaccagagcctgcgagggccaggagaacgccatcaagagcctggagcacgtgcagttcgaggccaccatcgagtacagcagaagaggcgacctgcacgtgaccctgaccagcgccgccggcaccagcaccgtgctgctggccgagagagagagagacaccagccccaacggcttcaagaactgggacttcatgagcgtgcacacctggggcgagaaccccatcggcacctggaccctgagaatcaccgacatgagcggcagaatccagaacgagggcagaatcgtgaactggaagctgatcctgcacggcaccagcagccagcccgagcacatgaagcagcccagagtgtacaccagctacaacaccgtgcagaacgacagaagaggcgtggagaagatggtggaccccggcgaggagcagcccacccaggagaaccccaaggagaacaccctggtgagcaagagccccagcagcagcagcgtgggcggcagaagagacgagctggaggagggcgcccccagccaggccatgctgagactgctgcagagcgccttcagcaagaacagcccccccaagcagagccccaagaagagccccagcgccaagctgaacatcccctacgagaacttctacgaggccctggagaagctgaacaagcccagccagctgaaggacagcgaggacagcctgtacaacgactacgtggacgtgttctacaacaccaagccctacaagcacagagacgacagactgctgcaggccctggtggacatcctgaacgaggagaactag

SEQ ID NO: 94760 - DNA, 798 bp, Artificial Sequence; identical to SEQ ID NO: 93816
  Description of Artificial Sequence: Synthetic coding sequence

SEQ ID NO: 94761 - DNA, 1917 bp, Artificial Sequence
  Description of Artificial Sequence: Synthetic coding sequence
atgaagggcggctgcgtgagccagtggaaggccgccgccggcttcctgttctgcgtgatggtgttcgccagcgccgagagacccgtgttcaccaaccacttcctggtggagctgcacaagggcggcgaggacaaggccagacaggtggccgccgagcacggcttcggcgtgagaaagctgcccttcgccgagggcctgtaccacttctaccacaacggcctggccaaggccaagagaagaagaagcctgcaccacaagcagcagctggagagagaccccagagtgaagatggccctgcagcaggagggcttcgacagaaagaagagaggctacagagacatcaacgagatcgacatcaacatgaacgaccccctgttcaccaagcagtggtacctgatcaacaccggccaggccgacggcacccccggcctggacctgaacgtggccgaggcctgggagctgggctacaccggcaagggcgtgaccatcggcatcatggacgacggcatcgactacctgcaccccgacctggccagcaactacaacgccgaggccagctacgacttcagcagcaacgacccctacccctaccccagatacaccgacgactggttcaacagccacggcaccagatgcgccggcgaggtgagcgccgccgccaacaacaacatctgcggcgtgggcgtggcctacaacagcaaggtggccggcatcagaatgctggaccagcccttcatgaccgacatcatcgaggccagcagcatcagccacatgccccagctgatcgacatctacagcgccagctggggccccaccgacaacggcaagaccgtggacggccccagagagctgaccctgcaggccatggccgacggcgtgaacaagggcagaggcggcaagggcagcatctacgtgtgggccagcggcgacggcggcagctacgacgactgcaactgcgacggctacgccagcagcatgtggaccatcagcatcaacagcgccatcaacgacggcagaaccgccctgtacgacgagagctgcagcagcaccctggccagcaccttcagcaacggcagaaagagaaaccccgaggccggcgtggccaccaccgacctgtacggcaactgcaccctgagacacagcggcaccagcgccgccgcccccgaggccgccggcgtgttcgccctggccctggaggccaacctgggcctgacctggagagacatgcagcacctgaccgtgctgaccagcaagagaaaccagctgcacgacgaggtgcaccagtggagaagaaacggcgtgggcctggagttcaaccacctgttcggctacggcgtgctggacgccggcgccatggtgaagatggccaaggactggaagaccgtgcccgagagattccactgcgtgggcggcagcgtgcaggaccccgagaagatccccagcaccggcaagctggtgctgaccctgaccaccgacgcctgcgagggcaaggagaacttcgtgagatacctggagcacgtgcaggccgtgatcaccgtgaacgccaccagaagaggcgacctgaacatcaacatgaccagccccatgggcaccaagagcatcctgctgagcagaagacccagagacgacgacagcaaggtgggcttcgacaagtggcccttcatgaccacccacacctggggcgaggacgccagaggcacctggaccctggagctgggcttcgtgggcagcgccccccagaagggcgtgctgaaggagtggaccctgatgctgcacggcacccagagcgccccctacatcgaccaggtggtgagagactaccagagcaagctggccatgagcaagaaggaggagctggaggaggagctggacgaggccgtggagagaagcctgaagagcatcctgaacaagaactag

SEQ ID NO: 94762 - DNA, 1860 bp, Artificial Sequence
  Description of Artificial Sequence: Synthetic coding sequence
atggtgttcgccagcgccgagagacccgtgttcaccaaccacttcctggtggagctgcacaagggcggcgaggacaaggccagacaggtggccgccgagcacggcttcggcgtgagaaagctgcccttcgccgagggcctgtaccacttctaccacaacggcctggccaaggccaagagaagaagaagcctgcaccacaagcagcagctggagagagaccccagagtgaagatggccctgcagcaggagggcttcgacagaaagaagagaggctacagagacatcaacgagatcgacatcaacatgaacgaccccctgttcaccaagcagtggtacctgatcaacaccggccaggccgacggcacccccggcctggacctgaacgtggccgaggcctgggagctgggctacaccggcaagggcgtgaccatcggcatcatggacgacggcatcgactacctgcaccccgacctggccagcaactacaacgccgaggccagctacgacttcagcagcaacgacccctacccctaccccagatacaccgacgactggttcaacagccacggcaccagatgcgccggcgaggtgagcgccgccgccaacaacaacatctgcggcgtgggcgtggcctacaacagcaaggtggccggcatcagaatgctggaccagcccttcatgaccgacatcatcgaggccagcagcatcagccacatgccccagctgatcgacatctacagcgccagctggggccccaccgacaacggcaagaccgtggacggccccagagagctgaccctgcaggccatggccgacggcgtgaacaagggcagaggcggcaagggcagcatctacgtgtgggccagcggcgacggcggcagctacgacgactgcaactgcgacggctacgccagcagcatgtggaccatcagcatcaacagcgccatcaacgacggcagaaccgccctgtacgacgagagctgcagcagcaccctggccagcaccttcagcaacggcagaaagagaaaccccgaggccggcgtggccaccaccgacctgtacggcaactgcaccctgagacacagcggcaccagcgccgccgcccccgaggccgccggcgtgttcgccctggccctggaggccaacctgggcctgacctggagagacatgcagcacctgaccgtgctgaccagcaagagaaaccagctgcacgacgaggtgcaccagtggagaagaaacggcgtgggcctggagttcaaccacctgttcggctacggcgtgctggacgccggcgccatggtgaagatggccaaggactggaagaccgtgcccgagagattccactgcgtgggcggcagcgtgcaggaccccgagaagatccccagcaccggcaagctggtgctgaccctgaccaccgacgcctgcgagggcaaggagaacttcgtgagatacctggagcacgtgcaggccgtgatcaccgtgaacgccaccagaagaggcgacctgaacatcaacatgaccagccccatgggcaccaagagcatcctgctgagcagaagacccagagacgacgacagcaaggtgggcttcgacaagtggcccttcatgaccacccacacctggggcgaggacgccagaggcacctggaccctggagctgggcttcgtgggcagcgccccccagaagggcgtgctgaaggagtggaccctgatgctgcacggcacccagagcgccccctacatcgaccaggtggtgagagactaccagagcaagctggccatgagcaagaaggaggagctggaggaggagctggacgaggccgtggagagaagcctgaagagcatcctgaacaagaactag

SEQ ID NO: 94763 - DNA, 1812 bp, Artificial Sequence
  Description of Artificial Sequence: Synthetic coding sequence
atgaagggcggctgcgtgagccagtggaaggccgccgccggcttcctgttctgcgtgatggtgttcgccagcgccgagagacccgtgttcaccaaccacttcctggtggagctgcacaagggcggcgaggacaaggccagacaggtggccgccgagcacggcttcggcgtgagaaaggtgaagatggccctgcagcaggagggcttcgacagaaagaagagaggctacagagacatcaacgagatcgacatcaacatgaacgaccccctgttcaccaagcagtggtacctgatcaacaccggccaggccgacggcacccccggcctggacctgaacgtggccgaggcctgggagctgggctacaccggcaagggcgtgaccatcggcatcatggacgacggcatcgactacctgcaccccgacctggccagcaactacaacgccgaggccagctacgacttcagcagcaacgacccctacccctaccccagatacaccgacgactggttcaacagccacggcaccagatgcgccggcgaggtgagcgccgccgccaacaacaacatctgcggcgtgggcgtggcctacaacagcaaggtggccggcatcagaatgctggaccagcccttcatgaccgacatcatcgaggccagcagcatcagccacatgccccagctgatcgacatctacagcgccagctggggccccaccgacaacggcaagaccgtggacggccccagagagctgaccctgcaggccatggccgacggcgtgaacaagggcagaggcggcaagggcagcatctacgtgtgggccagcggcgacggcggcagctacgacgactgcaactgcgacggctacgccagcagcatgtggaccatcagcatcaacagcgccatcaacgacggcagaaccgccctgtacgacgagagctgcagcagcaccctggccagcaccttcagcaacggcagaaagagaaaccccgaggccggcgtggccaccaccgacctgtacggcaactgcaccctgagacacagcggcaccagcgccgccgcccccgaggccgccggcgtgttcgccctggccctggaggccaacctgggcctgacctggagagacatgcagcacctgaccgtgctgaccagcaagagaaaccagctgcacgacgaggtgcaccagtggagaagaaacggcgtgggcctggagttcaaccacctgttcggctacggcgtgctggacgccggcgccatggtgaagatggccaaggactggaagaccgtgcccgagagattccactgcgtgggcggcagcgtgcaggaccccgagaagatccccagcaccggcaagctggtgctgaccctgaccaccgacgcctgcgagggcaaggagaacttcgtgagatacctggagcacgtgcaggccgtgatcaccgtgaacgccaccagaagaggcgacctgaacatcaacatgaccagccccatgggcaccaagagcatcctgctgagcagaagacccagagacgacgacagcaaggtgggcttcgacaagtggcccttcatgaccacccacacctggggcgaggacgccagaggcacctggaccctggagctgggcttcgtgggcagcgccccccagaagggcgtgctgaaggagtggaccctgatgctgcacggcacccagagcgccccctacatcgaccaggtggtgagagactaccagagcaagctggccatgagcaagaaggaggagctggaggaggagctggacgaggccgtggagagaagcctgaagagcatcctgaacaagaactag

SEQ ID NO: 94764 - DNA, 2268 bp, Artificial Sequence
  Description of Artificial Sequence: Synthetic coding sequence
atgagacccgcccccatcgccctgtggctgagactggtgctggccctggccctggtgagacccagagccgtgggctgggcccccgtgagagcccccatctacgtgagcagctgggccgtgcaggtgagccagggcaacagagaggtggagagactggccagaaagttcggcttcgtgaacctgggccccatcttccccgacggccagtacttccacctgagacacagaggcgtggtgcagcagagcctgaccccccactggggccacagactgcacctgaagaagaaccccaaggtgcagtggttccagcagcagaccctgcagagaagagtgaagagaagcgtggtggtgcccaccgacccctggttcagcaagcagtggtacatgaacagcgaggcccagcccgacctgagcatcctgcaggcctggagccagggcctgagcggccagggcatcgtggtgagcgtgctggacgacggcatcgagaaggaccaccccgacctgtgggccaactacgaccccctggccagctacgacttcaacgactacgaccccgacccccagcccagatacacccccagcaaggagaacagacacggcaccagatgcgccggcgaggtggccgccatggccaacaacggcttctgcggcgtgggcgtggccttcaacgccagaatcggcggcgtgagaatgctggacggcaccatcaccgacgtgatcgaggcccagagcctgagcctgcagccccagcacatccacatctacagcgccagctggggccccgaggacgacggcagaaccgtggacggccccggcatcctgaccagagaggccttcagaagaggcgtgaccaagggcagaggcggcctgggcaccctgttcatctgggccagcggcaacggcggcctgcactacgacaactgcaactgcgacggctacaccaacagcatccacaccctgagcgtgggcagcaccacccagcagggcagagtgccctggtacagcgaggcctgcgccagcaccctgaccaccacctacagcagcggcgtggccaccgacccccagatcgtgaccaccgacctgcaccacggctgcaccgaccagcacaccggcaccagcgccagcgcccccctggccgccggcatgatcgccctggccctggaggccaaccccttcctgacctggagagacatgcagcacctggtggtgagagccagcaagcccgcccacctgcaggccgaggactggagaaccaacggcgtgggcagacaggtgagccaccactacggctacggcctgctggacgccggcctgctggtggacaccgccagaacctggctgcccacccagccccagagaaagtgcgccgtgagagtgcagagcagacccacccccatcctgcccctgatctacatcagagagaacgtgagcgcctgcgccggcctgcacaacagcatcagaagcctggagcacgtgcaggcccagctgaccctgagctacagcagaagaggcgacctggagatcagcctgaccagccccatgggcaccagaagcaccctggtggccatcagacccctggacgtgagcaccgagggctacaacaactgggtgttcatgagcacccacttctgggacgagaacccccagggcgtgtggaccctgggcctggagaacaagggctactacttcaacaccggcaccctgtacagatacaccctgctgctgtacggcaccgccgaggacatgaccgccagacccaccggcccccaggtgaccagcagcgcctgcgtgcagagagacaccgagggcctgtgccaggcctgcgacggccccgcctacatcctgggccagctgtgcctggcctactgcccccccagattcttcaaccacaccagactggtgaccgccggccccggccacaccgccgcccccgccctgagagtgtgcagcagctgccacgccagctgctacacctgcagaggcggcagccccagagactgcaccagctgcccccccagcagcaccctggaccagcagcagggcagctgcatgggccccaccacccccgacagcagacccagactgagagccgccgcctgcccccaccacagatgccccgccagcgccatggtgctgagcctgctggccgtgaccctgggcggccccgtgctgtgcggcatgagcatggacctgcccctgtacgcctggctgagcagagccagagccacccccaccaagccccaggtgtggctgcccgccggcacctag

SEQ ID NO: 94765 - DNA, 1137 bp, Artificial Sequence
  Description of Artificial Sequence: Synthetic coding sequence
atggccagcagaagaaccaccagaaccagcggccccaccaccaccccctggcccgccatgaccagcatgaccaccaccagaacccccagccccgccaccccccccgccaagagaaccggcgtgagaatgctggacggcaccatcaccgacgtgatcgaggcccagagcctgagcctgcagccccagcacatccacatctacagcgccagctggggccccgaggacgacggcagaaccgtggacggccccggcatcctgaccagagaggccttcagaagaggcgtgaccaagggcagaggcggcctgggcaccctgttcatctgggccagcggcaacggcggcctgcactacgacaactgcaactgcgacggctacaccaacagcatccacaccctgagcgtgggcagcaccacccagcagggcagagtgccctggtacagcgaggcctgcgccagcaccctgaccaccacctacagcagcggcgtggccaccgacccccagatcgtgaccaccgacctgcaccacggctgcaccgaccagcacaccggcaccagcgccagcgcccccctggccgccggcatgatcgccctggccctggaggccaaccccttcctgacctggagagacatgcagcacctggtggtgagagccagcaagcccgcccacctgcaggccgaggactggagaaccaacggcgtgggcagacaggtgagccaccactacggctacggcctgctggacgccggcctgctggtggacaccgccagaacctggctgcccacccagccccagagaaagtgcgccgtgagagtgcagagcagacccacccccatcctgcccctgatctacatcagagagaacgtgagcgcctgcgccggcctgcacaacagcatcagaagcctggagcacgtgcaggcccagctgaccctgagctacagcagaagaggcgacctggagatcagcctgaccagccccatgggcaccagaagcaccctggtggccatcagagacgtggtgcccctgcacgccgccgccctgtgggacggcagaggccacgacagcgccgcctacagaccccccggcgaccagcagagagtgtgcgccgccggccacagaggcgccgtgcccggcgtgtag

SEQ ID NO: 94766 - DNA, 2742 bp, Artificial Sequence
  Description of Artificial Sequence: Synthetic coding sequence
atgggctggggcagcagatgctgctgccccggcagactggacctgctgtgcgtgctggccctgctgggcggctgcctgctgcccgtgtgcagaaccagagtgtacaccaaccactgggccgtgaagatcgccggcggcttccccgaggccaacagaatcgccagcaagtacggcttcatcaacatcggccagatcggcgccctgaaggactactaccacttctaccacagcagaaccatcaagagaagcgtgatcagcagcagaggcacccacagcttcatcagcatggagcccaaggtggagtggatccagcagcaggtggtgaagaagagaaccaagagagactacgacttcagcagagcccagagcacctacttcaacgaccccaagtggcccagcatgtggtacatgcactgcagcgacaacacccacccctgccagagcgacatgaacatcgagggcgcctggaagagaggctacaccggcaagaacatcgtggtgaccatcctggacgacggcatcgagagaacccaccccgacctgatgcagaactacgacgccctggccagctgcgacgtgaacggcaacgacctggaccccatgcccagatacgacgccagcaacgagaacaagcacggcaccagatgcgccggcgaggtggccgccgccgccaacaacagccactgcaccgtgggcatcgccttcaacgccaagatcggcggcgtgagaatgctggacggcgacgtgaccgacatggtggaggccaagagcgtgagcttcaacccccagcacgtgcacatctacagcgccagctggggccccgacgacgacggcaagaccgtggacggccccgcccccctgaccagacaggccttcgagaacggcgtgagaatgggcagaagaggcctgggcagcgtgttcgtgtgggccagcggcaacggcggcagaagcaaggaccactgcagctgcgacggctacaccaacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcccctgcgaccccgagtgcagcgaggtgggctgcgacggccccggccccgaccactgcaacgactgcctgcactactactacaagctgaagaacaacaccagaatctgcgtgagcagctgcccccccggccactaccacgccgacaagaagagatgcagaaagtgcgcccccaactgcgagagctgcttcggcagccacggcgaccagtgcatgagctgcaagtacggctacttcctgaacgaggagaccaacagctgcgtgacccactgccccgacggcagctaccaggacaccaagaagaacctgtgcagaaagtgcagcgagaactgcaagacctgcaccgagttccacaactgcaccgagtgcagagacggcctgagcctgcagggcagcagatgcagcgtgagctgcgaggacggcagatacttcaacggccaggactgccagccctgccacagattctgcgccacctgcgccggcgccggcgccgacggctgcatcaactgcaccgagggctacttcatggaggacggcagatgcgtgcagagctgcagcatcagctactacttcgaccacagcagcgagaacggctacaagagctgcaagaagtgcgacatcagctgcctgacctgcaacggccccggcttcaagaactgcaccagctgccccagcggctacctgctggacctgggcatgtgccagatgggcgccatctgcaaggacgccaccgaggagagctgggccgagggcggcttctgcatgctggtgaagaagaacaacctgtgccagagaaaggtgctgcagcagctgtgctgcaagacctgcaccttccagggctag

SEQ ID NO: 94767 - DNA, 4773 bp, Artificial Sequence
  Description of Artificial Sequence: Synthetic coding sequence
atgggcagaagaggcctgggcagcgtgttcgtgtgggccagcggcaacggcggcagaagcaaggaccactgcagctgcgacggctacaccaacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcccctgcgaccccgagtgcagcgaggtgggctgcgacggccccggccccgaccactgcaacgactgcctgcactactactacaagctgaagaacaacaccagaatctgcgtgagcagctgcccccccggccactaccacgccgacaagaagagatgcagaaagtgcgcccccaactgcgagagctgcttcggcagccacggcgaccagtgcatgagctgcaagtacggctacttcctgaacgaggagaccaacagctgcgtgacccactgccccgacggcagctaccaggacaccaagaagaacctgtgcagaaagtgcagcgagaactgcaagacctgcaccgagttccacaactgcaccgagtgcagagacggcctgagcctgcagggcagcagatgcagcgtgagctgcgaggacggcagatacttcaacggccaggactgccagccctgccacagattctgcgccacctgcgccggcgccggcgccgacggctgcatcaactgcaccgagggctacttcatggaggacggcagatgcgtgcagagctgcagcatcagctactacttcgaccacagcagcgagaacggctacaagagctgcaagaagtgcgacatcagctgcctgacctgcaacggccccggcttcaagaactgcaccagctgccccagcggctacctgctggacctgggcatgtgccagatgggcgccatctgcaaggacggcgagtacgtggacgagcacggccactgccagacctgcgaggccagctgcgccaagtgccagggccccacccaggaggactgcaccacctgccccatgaccagaatcttcgacgacggcagatgcgtgagcaactgccccagctggaagttcgagttcgagaaccagtgccacccctgccaccacacctgccagagatgccagggcagcggccccacccactgcaccagctgcggcgccgacaactacggcagagagcacttcctgtaccagggcgagtgcggcgacagctgccccgagggccactacgccaccgagggcaacacctgcctgccctgccccgacaactgcgagctgtgccacagcgtgcacgtgtgcaccagatgcatgaagggctacttcatcgcccccaccaaccacacctgccagaagctggagtgcggccagggcgaggtgcaggaccccgactacgaggagtgcgtgccctgcgaggagggctgcctgggctgcagcctggacgaccccggcacctgcaccagctgcgccatgggctactacagattcgaccaccactgctacaagacctgccccgagaagacctacagcgaggaggtggagtgcaaggcctgcgacagcaactgcggcagctgcgaccagaacggctgctactggtgcgaggagggcttcttcctgctgggcggcagctgcgtgagaaagtgcggccccggcttctacggcgaccaggagatgggcgagtgcgagagctgccacagagcctgcgagacctgcaccggccccggccacgacgagtgcagcagctgccaggagggcctgcagctgctgagaggcatgtgcgtgcacgccaccaagacccaggaggagggcaagttctggaacgaggccgtgagcaccgccaacctgagcgtggtgaagagcctgctgcaggagagaagaagatggaaggtgcagatcaagagagacatcctgagaaagctgcagccctgccacagcagctgcaagacctgcaacggcagcgccaccctgtgcaccagctgccccaagggcgcctacctgctggcccaggcctgcgtgagcagctgcccccagggcacctggcccagcgtgagaagcggcagctgcgagaactgcaccgaggcctgcgccatctgcagcggcgccgacctgtgcaagaagtgccagatgcagcccggccaccccctgttcctgcacgagggcagatgctacagcaagtgccccgagggcagctacgccgaggacggcatctgcgagagatgcagcagcccctgcagaacctgcgagggcaacgccaccaactgccacagctgcgagggcggccacgtgctgcaccacggcgtgtgccaggagaactgccccgagagacacgtggccgtgaagggcgtgtgcaagcactgccccgagatgtgccaggactgcatccacgagaagacctgcaaggagtgcacccccgagttcttcctgcacgacgacatgtgccaccagagctgccccagaggcttctacgccgacagcagacactgcgtgccctgccacaaggactgcctggagtgcagcggccccaaggccgacgactgcgagctgtgcctggagagcagctgggtgctgtacgacggcctgtgcctggaggagtgccccgccggcacctactacgagaaggagaccaaggagtgcagagactgccacaagagctgcctgacctgcagcagcagcggcacctgcaccacctgccagaagggcctgatcatgaaccccagaggcagctgcatggccaacgagaagtgcagccccagcgagtactgggacgaggacgcccccggctgcaagccctgccacgtgaagtgcttccactgcatgggccccgccgaggaccagtgccagacctgccccatgaacagcctgctgctgaacaccacctgcgtgaaggactgccccgagggctactacgccgacgaggacagcaacagatgcgcccactgccacagcagctgcagaacctgcgagggcagacacagcagacagtgccacagctgcagacccggctggttccagctgggcaaggagtgcctgctgcagtgcagagagggctactacgccgacaacagcaccggcagatgcgagagatgcaacagaagctgcaagggctgccagggccccagacccaccgactgcctgagctgcgacagattcttcttcctgctgagaagcaagggcgagtgccacagaagctgccccgaccactactacgtggagcagagcacccagacctgcgagagatgccaccccacctgcgaccagtgcaagggcaagggcgccctgaactgcctgagctgcgtgtggagctaccacctgatgggcggcatctgcaccagcgactgcctggtgggcgagtacagagtgggcgagggcgagaagttcaactgcgagaagtgccacgagagctgcatggagtgcaagggccccggcgccaagaactgcaccctgtgccccgccaacctggtgctgcacatggacgacagccactgcctgcactgctgcaacaccagcgacccccccagcgcccaggagtgctgcgactgccaggacaccaccgacgagtgcatcctgagaaccagcaaggtgagacccgccaccgagcacttcaagaccgccctgttcatcaccagcagcatgatgctggtgctgctgctgggcgccgccgtggtggtgtggaagaagagcagaggcagagtgcagcccgccgccaaggccggctacgagaagctggccgaccccaacaagagctacagcagctacaagagcagctacagagagagcaccagcttcgaggaggaccaggtgatcgagtacagagacagagactacgacgaggacgacgacgacgacatcgtgtacatgggccaggacggcaccgtgtacagaaagttcaagtacggcctgctggacgacgacgacatcgacgagctggagtacgacgacgagagctacagctactaccagtag

SEQ ID NO: 94768 - DNA, 2073 bp, Artificial Sequence
  Description of Artificial Sequence: Synthetic coding sequence
atgggctggggcagcagatgctgctgccccggcagactggacctgctgtgcgtgctggccctgctgggcggctgcctgctgcccgtgtgcagaaccagagtgtacaccaaccactgggccgtgaagatcgccggcggcttccccgaggccaacagaatcgccagcaagtacggcttcatcaacatcggccagatcggcgccctgaaggactactaccacttctaccacagcagaaccatcaagagaagcgtgatcagcagcagaggcacccacagcttcatcagcatggagcccaaggtggagtggatccagcagcaggtggtgaagaagagaaccaagagagactacgacttcagcagagcccagagcacctacttcaacgaccccaagtggcccagcatgtggtacatgcactgcagcgacaacacccacccctgccagagcgacatgaacatcgagggcgcctggaagagaggctacaccggcaagaacatcgtggtgaccatcctggacgacggcatcgagagaacccaccccgacctgatgcagaactacgacgccctggccagctgcgacgtgaacggcaacgacctggaccccatgcccagatacgacgccagcaacgagaacaagcacggcaccagatgcgccggcgaggtggccgccgccgccaacaacagccactgcaccgtgggcatcgccttcaacgccaagatcggcggcgtgagaatgctggacggcgacgtgaccgacatggtggaggccaagagcgtgagcttcaacccccagcacgtgcacatctacagcgccagctggggccccgacgacgacggcaagaccgtggacggccccgcccccctgaccagacaggccttcgagaacggcgtgagaatgggcagaagaggcctgggcagcgtgttcgtgtgggccagcggcaacggcggcagaagcaaggaccactgcagctgcgacggctacaccaacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcgagctggccagcagcggcacccaggccaagaagagacagctgatgcaccaccccaccacctgggagaacagaatggagtggaacggcatgaagtggaacggcatgaagtggaacggcatggagtggaacggcatggagtggaacagaatcgagagcaacagaatcgagtag

SEQ ID NO: 94769 - DNA, 2073 bp, Artificial Sequence
  Description of Artificial Sequence: Synthetic coding sequence
atgggctggggcagcagatgctgctgccccggcagactggacctgctgtgcgtgctggccctgctgggcggctgcctgctgcccgtgtgcagaaccagagtgtacaccaaccactgggccgtgaagatcgccggcggcttccccgaggccaacagaatcgccagcaagtacggcttcatcaacatcggccagatcggcgccctgaaggactactaccacttctaccacagcagaaccatcaagagaagcgtgatcagcagcagaggcacccacagcttcatcagcatggagcccaaggtggagtggatccagcagcaggtggtgaagaagagaaccaagagagactacgacttcagcagagcccagagcacctacttcaacgaccccaagtggcccagcatgtggtacatgcactgcagcgacaacacccacccctgccagagcgacatgaacatcgagggcgcctggaagagaggctacaccggcaagaacatcgtggtgaccatcctggacgacggcatcgagagaacccaccccgacctgatgcagaactacgacgccctggccagctgcgacgtgaacggcaacgacctggaccccatgcccagatacgacgccagcaacgagaacaagcacggcaccagatgcgccggcgaggtggccgccgccgccaacaacagccactgcaccgtgggcatcgccttcaacgccaagatcggcggcgtgagaatgctggacggcgacgtgaccgacatggtggaggccaagagcgtgagcttcaacccccagcacgtgcacatctacagcgccagctggggccccgacgacgacggcaagaccgtggacggccccgcccccctgaccagacaggccttcgagaacggcgtgagaatgggcagaagaggcctgggcagcgtgttcgtgtgggccagcggcaacggcggcagaagcaaggaccactgcagctgcgacggctacaccaacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcgagctggccagcagcggcacccaggccaagaagagacagctgatgcaccaccccaccacctgggagaacagaatggagtggaacggcatgaagtggaacggcatggagtggaacggcatggagtggaacggcatggagagcaacagaatcgagagcaacagaatcgagtag

SEQ ID NO: 94770 - DNA, 4683 bp, Artificial Sequence
  Description of Artificial Sequence: Synthetic coding sequence
aacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcccctgcgaccccgagtgcagcgaggtgggctgcgacggccccggccccgaccactgcaacgactgcctgcactactactacaagctgaagaacaacaccagaatctgcgtgagcagctgcccccccggccactaccacgccgacaagaagagatgcagaaagtgcgcccccaactgcgagagctgcttcggcagccacggcgaccagtgcatgagctgcaagtacggctacttcctgaacgaggagaccaacagctgcgtgacccactgccccgacggcagctaccaggacaccaagaagaacctgtgcagaaagtgcagcgagaactgcaagacctgcaccgagttccacaactgcaccgagtgcagagacggcctgagcctgcagggcagcagatgcagcgtgagctgcgaggacggcagatacttcaacggccaggactgccagccctgccacagattctgcgccacctgcgccggcgccggcgccgacggctgcatcaactgcaccgagggctacttcatggaggacggcagatgcgtgcagagctgcagcatcagctactacttcgaccacagcagcgagaacggctacaagagctgcaagaagtgcgacatcagctgcctgacctgcaacggccccggcttcaagaactgcaccagctgccccagcggctacctgctggacctgggcatgtgccagatgggcgccatctgcaaggacggcgagtacgtggacgagcacggccactgccagacctgcgaggccagctgcgccaagtgccagggccccacccaggaggactgcaccacctgccccatgaccagaatcttcgacgacggcagatgcgtgagcaactgccccagctggaagttcgagttcgagaaccagtgccacccctgccaccacacctgccagagatgccagggcagcggccccacccactgcaccagctgcggcgccgacaactacggcagagagcacttcctgtaccagggcgagtgcggcgacagctgccccgagggccactacgccaccgagggcaacacctgcctgccctgccccgacaactgcgagctgtgccacagcgtgcacgtgtgcaccagatgcatgaagggctacttcatcgcccccaccaaccacacctgccagaagctggagtgcggccagggcgaggtgcaggaccccgactacgaggagtgcgtgccctgcgaggagggctgcctgggctgcagcctggacgaccccggcacctgcaccagctgcgccatgggctactacagattcgaccaccactgctacaagacctgccccgagaagacctacagcgaggaggtggagtgcaaggcctgcgacagcaactgcggcagctgcgaccagaacggctgctactggtgcgaggagggcttcttcctgctgggcggcagctgcgtgagaaagtgcggccccggcttctacggcgaccaggagatgggcgagtgcgagagctgccacagagcctgcgagacctgcaccggccccggccacgacgagtgcagcagctgccaggagggcctgcagctgctgagaggcatgtgcgtgcacgccaccaagacccaggaggagggcaagttctggaacgaggccgtgagcaccgccaacctgagcgtggtgaagagcctgctgcaggagagaagaagatggaaggtgcagatcaagagagacatcctgagaaagctgcagccctgccacagcagctgcaagacctgcaacggcagcgccaccctgtgcaccagctgccccaagggcgcctacctgctggcccaggcctgcgtgagcagctgcccccagggcacctggcccagcgtgagaagcggcagctgcgagaactgcaccgaggcctgcgccatctgcagcggcgccgacctgtgcaagaagtgccagatgcagcccggccaccccctgttcctgcacgagggcagatgctacagcaagtgccccgagggcagctacgccgaggacggcatctgcgagagatgcagcagcccctgcagaacctgcgagggcaacgccaccaactgccacagctgcgagggcggccacgtgctgcaccacggcgtgtgccaggagaactgccccgagagacacgtggccgtgaagggcgtgtgcaagcactgccccgagatgtgccaggactgcatccacgagaagacctgcaaggagtgcacccccgagttcttcctgcacgacgacatgtgccaccagagctgccccagaggcttctacgccgacagcagacactgcgtgccctgccacaaggactgcctggagtgcagcggccccaaggccgacgactgcgagctgtgcctggagagcagctgggtgctgtacgacggcctgtgcctggaggagtgccccgccggcacctactacgagaaggagaccaaggagtgcagagactgccacaagagctgcctgacctgcagcagcagcggcacctgcaccacctgccagaagggcctgatcatgaaccccagaggcagctgcatggccaacgagaagtgcagccccagcgagtactgggacgaggacgcccccggctgcaagccctgccacgtgaagtgcttccactgcatgggccccgccgaggaccagtgccagacctgccccatgaacagcctgctgctgaacaccacctgcgtgaaggactgccccgagggctactacgccgacgaggacagcaacagatgcgcccactgccacagcagctgcagaacctgcgagggcagacacagcagacagtgccacagctgcagacccggctggttccagctgggcaaggagtgcctgctgcagtgcagagagggctactacgccgacaacagcaccggcagatgcgagagatgcaacagaagctgcaagggctgccagggccccagacccaccgactgcctgagctgcgacagattcttcttcctgctgagaagcaagggcgagtgccacagaagctgccccgaccactactacgtggagcagagcacccagacctgcgagagatgccaccccacctgcgaccagtgcaagggcaagggcgccctgaactgcctgagctgcgtgtggagctaccacctgatgggcggcatctgcaccagcgactgcctggtgggcgagtacagagtgggcgagggcgagaagttcaactgcgagaagtgccacgagagctgcatggagtgcaagggccccggcgccaagaactgcaccctgtgccccgccaacctggtgctgcacatggacgacagccactgcctgcactgctgcaacaccagcgacccccccagcgcccaggagtgctgcgactgccaggacaccaccgacgagtgcatcctgagaaccagcaaggtgagacccgccaccgagcacttcaagaccgccctgttcatcaccagcagcatgatgctggtgctgctgctgggcgccgccgtggtggtgtggaagaagagcagaggcagagtgcagcccgccgccaaggccggctacgagaagctggccgaccccaacaagagctacagcagctacaagagcagctacagagagagcaccagcttcgaggaggaccaggtgatcgagtacagagacagagactacgacgaggacgacgacgacgacatcgtgtacatgggccaggacggcaccgtgtacagaaagttcaagtacggcctgctggacgacgacgacatcgacgagctggagtacgacgacgagagctacagctactaccagtag

SEQ ID NO: 94771 - DNA, 306 bp, Artificial Sequence
  Description of Artificial Sequence: Synthetic coding sequence
tgccagccctgccacagattctgcgccacctgcgccggcgccggcgccgacggctgcatcaactgcaccgagggctacttcatggaggacggcagatgcgtgcagagctgcagcatcagctactacttcgaccacagcagcgagaacggctacaagagctgcaagaagtgcgacatcagctgcctgacctgcaacggccccggcttcaagaactgcaccagctgccccagcggctacctgctggacctgggcatgtgccagatgggcgccatctgcaaggacgtgagcctgttcagaggcgcctag

SEQ ID NO: 94772 - DNA, 5583 bp, Artificial Sequence
  Description of Artificial Sequence: Synthetic coding sequence
atgggctggggcagcagatgctgctgccccggcagactggacctgctgtgcgtgctggccctgctgggcggctgcctgctgcccgtgtgcagaaccagagtgtacaccaaccactgggccgtgaagatcgccggcggcttccccgaggccaacagaatcgccagcaagtacggcttcatcaacatcggccagatcggcgccctgaaggactactaccacttctaccacagcagaaccatcaagagaagcgtgatcagcagcagaggcacccacagcttcatcagcatggagcccaaggtggagtggatccagcagcaggtggtgaagaagagaaccaagagagactacgacttcagcagagcccagagcacctacttcaacgaccccaagtggcccagcatgtggtacatgcactgcagcgacaacacccacccctgccagagcgacatgaacatcgagggcgcctggaagagaggctacaccggcaagaacatcgtggtgaccatcctggacgacggcatcgagagaacccaccccgacctgatgcagaactacgacgccctggccagctgcgacgtgaacggcaacgacctggaccccatgcccagatacgacgccagcaacgagaacaagcacggcaccagatgcgccggcgaggtggccgccgccgccaacaacagccactgcaccgtgggcatcgccttcaacgccaagatcggcggcgtgagaatgctggacggcgacgtgaccgacatggtggaggccaagagcgtgagcttcaacccccagcacgtgcacatctacagcgccagctggggccccgacgacgacggcaagaccgtggacggccccgcccccctgaccagacaggccttcgagaacggcgtgagaatgggcagaagaggcctgggcagcgtgttcgtgtgggccagcggcaacggcggcagaagcaaggaccactgcagctgcgacggctacaccaacagcatctacaccatcagcatcagcagcaccgccgagagcggcaagaagccctggtacctggaggagtgcagcagcaccctggccaccacctacagcagcggcgagagctacgacaagaagatcatcaccaccgacctgagacagagatgcaccgacaaccacaccggcaccagcgccagcgcccccatggccgccggcatcatcgccctggccctggaggccaaccccttcctgacctggagagacgtgcagcacgtgatcgtgagaaccagcagagccggccacctgaacgccaacgactggaagaccaacgccgccggcttcaaggtgagccacctgtacggcttcggcctgatggacgccgaggccatggtgatggaggccgagaagtggaccaccgtgcccagacagcacgtgtgcgtggagagcaccgacagacagatcaagaccatcagacccaacagcgccgtgagaagcatctacaaggccagcggctgcagcgacaaccccaacagacacgtgaactacctggagcacgtggtggtgagaatcaccatcacccaccccagaagaggcgacctggccatctacctgaccagccccagcggcaccagaagccagctgctggccaacagactgttcgaccacagcatggagggcttcaagaactgggagttcatgaccatccactgctggggcgagagagccgccggcgactgggtgctggaggtgtacgacacccccagccagctgagaaacttcaagacccccggcaagctgaaggagtggagcctggtgctgtacggcaccagcgtgcagccctacagccccaccaacgagttccccaaggtggagagattcagatacagcagagtggaggaccccaccgacgactacggcaccgaggactacgccggcccctgcgaccccgagtgcagcgaggtgggctgcgacggccccggccccgaccactgcaacgactgcctgcactactactacaagctgaagaacaacaccagaatctgcgtgagcagctgcccccccggccactaccacgccgacaagaagagatgcagaaagtgcgcccccaactgcgagagctgcttcggcagccacggcgaccagtgcatgagctgcaagtacggctacttcctgaacgaggagaccaacagctgcgtgacccactgccccgacggcagctaccaggacaccaagaagaacctgtgcagaaagtgcagcgagaactgcaagacctgcaccgagttccacaactgcaccgagtgcagagacggcctgagcctgcagggcagcagatgcagcgtgagctgcgaggacggcagatacttcaacggccaggactgccagccctgccacagattctgcgccacctgcgccggcgccggcgccgacggctgcatcaactgcaccgagggctacttcatggaggacggcagatgcgtgcagagctgcagcatcagctactacttcgaccacagcagcgagaacggctacaagagctgcaagaagtgcgacatcagctgcctgacctgcaacggccccggcttcaagaactgcaccagctgccccagcggctacctgctggacctgggcatgtgccagatgggcgccatctgcaaggacggcgagtacgtggacgagcacggccactgccagacctgcgaggccagctgcgccaagtgccagggccccacccaggaggactgcaccacctgccccatgaccagaatcttcgacgacggcagatgcgtgagcaactgccccagctggaagttcgagttcgagaaccagtgccacccctgccaccacacctgccagagatgccagggcagcggccccacccactgcaccagctgcggcgccgacaactacggcagagagcacttcctgtaccagggcgagtgcggcgacagctgccccgagggccactacgccaccgagggcaacacctgcctgccctgccccgacaactgcgagctgtgccacagcgtgcacgtgtgcaccagatgcatgaagggctacttcatcgcccccaccaaccacacctgccagaagctggagtgcggccagggcgaggtgcaggaccccgactacgaggagtgcgtgccctgcgaggagggctgcctgggctgcagcctggacgaccccggcacctgcaccagctgcgccatgggctactacagattcgaccaccactgctacaagacctgccccgagaagacctacagcgaggaggtggagtgcaaggcctgcgacagcaactgcggcagctgcgaccagaacggctgctactggtgcgaggagggcttcttcctgctgggcggcagctgcgtgagaaagtgcggccccggcttctacggcgaccaggagatgggcgagtgcgagagctgccacagagcctgcgagacctgcaccggccccggccacgacgagtgcagcagctgccaggagggcctgcagctgctgagaggcatgtgcgtgcacgccaccaagacccaggaggagggcaagttctggaacgacatcctgagaaagctgcagccctgccacagcagctgcaagacctgcaacggcagcgccaccctgtgcaccagctgccccaagggcgcctacctgctggcccaggcctgcgtgagcagctgcccccagggcacctggcccagcgtgagaagcggcagctgcgagaactgcaccgaggcctgcgccatctgcagcggcgccgacctgtgcaagaagtgccagatgcagcccggccaccccctgttcctgcacgagggcagatgctacagcaagtgccccgagggcagctacgccgaggacggcatctgcgagagatgcagcagcccctgcagaacctgcgagggcaacgccaccaactgccacagctgcgagggcggccacgtgctgcaccacggcgtgtgccaggagaactgccccgagagacacgtggccgtgaagggcgtgtgcaagcactgccccgagatgtgccaggactgcatccacgagaagacctgcaaggagtgcacccccgagttcttcctgcacgacgacatgtgccaccagagctgccccagaggcttctacgccgacagcagacactgcgtgccctgccacaaggactgcctggagtgcagcggccccaaggccgacgactgcgagctgtgcctggagagcagctgggtgctgtacgacggcctgtgcctggaggagtgccccgccggcacctactacgagaaggagaccaaggagtgcagagactgccacaagagctgcctgacctgcagcagcagcggcacctgcaccacctgccagaagggcctgatcatgaaccccagaggcagctgcatggccaacgagaagtgcagccccagcgagtactgggacgaggacgcccccggctgcaagccctgccacgtgaagtgcttccactgcatgggccccgccgaggaccagtgccagacctgccccatgaacagcctgctgctgaacaccacctgcgtgaaggactgccccgagggctactacgccgacgaggacagcaacagatgcgcccactgccacagcagctgcagaacctgcgagggcagacacagcagacagtgccacagctgcagacccggctggttccagctgggcaaggagtgcctgctgcagtgcagagagggctactacgccgacaacagcaccggcagatgcgagagatgcaacagaagctgcaagggctgccagggccccagacccaccgactgcctgagctgcgacagattcttcttcctgctgagaagcaagggcgagtgccacagaagctgccccgaccactactacgtggagcagagcacccagacctgcgagagatgccaccccacctgcgaccagtgcaagggcaagggcgccctgaactgcctgagctgcgtgtggagctaccacctgatgggcggcatctgcaccagcgactgcctggtgggcgagtacagagtgggcgagggcgagaagttcaactgcgagaagtgccacgagagctgcatggagtgcaagggccccggcgccaagaactgcaccctgtgccccgccaacctggtgctgcacatggacgacagccactgcctgcactgctgcaacaccagcgacccccccagcgcccaggagtgctgcgactgccaggacaccaccgacgagtgcatcctgagaaccagcaaggtgagacccgccaccgagcacttcaagaccgccctgttcatcaccagcagcatgatgctggtgctgctgctgggcgccgccgtggtggtgtggaagaagagcagaggcagagtgcagcccgccgccaaggccggctacgagaagctggccgaccccaacaagagctacagcagctacaagagcagctacagagagagcaccagcttcgaggaggaccaggtgatcgagtacagagacagagactacgacgaggacgacgacgacgacatcgtgtacatgggccaggacggcaccgtgtacagaaagttcaagtacggcctgctggacgacgacgacatcgacgagctggagtacgacgacgagagctacagctactaccagtag

SEQ ID NO: 94773 - DNA, 1497 bp, Artificial Sequence
  Description of Artificial Sequence: Synthetic coding sequence
atctggaacgtgcaccactgcggcgacaagaacagcagatgcagaagcgagatgaacgtgcaggccgcctggaagagaggctacaccggcaagaacgtggtggtgaccatcctggacgacggcatcgagagaaaccaccccgacctggcccccaactacgacagctacgccagctacgacgtgaacggcaacgactacgaccccagccccagatacgacgccagcaacgagaacaagcacggcaccagatgcgccggcgaggtggccgccagcgccaacaacagctactgcatcgtgggcatcgcctacaacgccaagatcggcggcatcagaatgctggacggcgacgtgaccgacgtggtggaggccaagagcctgggcatcagacccaactacatcgacatctacagcgccagctggggccccgacgacgacggcaagaccgtggacggccccggcagactggccaagcaggccttcgagtacggcatcaagaagggcagacagggcctgggcagcatcttcgtgtgggccagcggcaacggcggcagagagggcgactactgcagctgcgacggctacaccaacagcatctacaccatcagcgtgagcagcgccaccgagaacggctacaagccctggtacctggaggagtgcgccagcaccctggccaccacctacagcagcggcgccttctacgagagaaagatcgtgaccaccgacctgagacagagatgcaccgacggccacaccggcaccagcgtgagcgcccccatggtggccggcatcatcgccctggccctggaggccaacagccagctgacctggagagacgtgcagcacctgctggtgaagaccagcagacccgcccacctgaaggccagcgactggaaggtgaacggcgccggccacaaggtgagccacttctacggcttcggcctggtggacgccgaggccctggtggtggaggccaagaagtggaccgccgtgcccagccagcacatgtgcgtggccgccagcgacaagagacccagaagcatccccctggtgcaggtgctgagaaccaccgccctgaccagcgcctgcgccgagcacagcgaccagagagtggtgtacctggagcacgtggtggtgagaaccagcatcagccaccccagaagaggcgacctgcagatctacctggtgagccccagcggcaccaagagccagctgctggccaagagactgctggacctgagcaacgagggcttcaccaactgggagttcatgaccgtgcactgctggggcgagaaggccgagggccagtggaccctggagatccaggacctgcccagccaggtgagaaaccccgagaagcagggcgacctggagacccccgtggccaaccagctgaccaccgaggagagattcgtgagcaccctgagcatcctgttccactggagcgtgtacctgagctggagccagtaccacatcgtgctgatcaccgtggccctgtag

SEQ ID NO: 94774 - DNA, 1956 bp, Artificial Sequence
  Description of Artificial Sequence: Synthetic coding sequence
atgccccccagagccccccccgcccccggccccagacccccccccagagccgccgccgccaccgacaccgccgccggcgccggcggcgccggcggcgccggcggcgccggcggccccggcttcagacccctggcccccagaccctggagatggctgctgctgctggccctgcccgccgcctgcagccccccccccagacccgtgtacaccaaccactgggccgtgcaggtgctgggcggccccgccgaggccgacagagtggccgccgcccacggctacctgaacctgggccagatcggcaacctggaggactactaccacttctaccacagcaagaccttcaagagaagcaccctgagcagcagaggcccccacaccttcctgagaatggacccccaggtgaagtggctgcagcagcaggaggtgaagagaagagtgaagagacaggtgagaagcgacccccaggccctgtacttcaacgaccccatctggagcaacatgtggtacctgcactgcggcgacaagaacagcagatgcagaagcgagatgaacgtgcaggccgcctggaagagaggctacaccggcaagaacgtggtggtgaccatcctggacgacggcatcgagagaaaccaccccgacctggcccccaactacgacagctacgccagctacgacgtgaacggcaacgactacgaccccagccccagatacgacgccagcaacgagaacaagcacggcaccagatgcgccggcgaggtggccgccagcgccaacaacagctactgcatcgtgggcatcgcctacaacgccaagatcggcggcatcagaatgctggacggcgacgtgaccgacgtggtggaggccaagagcctgggcatcagacccaactacatcgacatctacagcgccagctggggccccgacgacgacggcaagaccgtggacggccccggcagactggccaagcaggccttcgagtacggcatcaagaagggcagacagggcctgggcagcatcttcgtgtgggccagcggcaacggcggcagagagggcgactactgcagctgcgacggctacaccaacagcatctacaccatcagcgtgagcagcgccaccgagaacggctacaagccctggtacctggaggagtgcgccagcaccctggccaccacctacagcagcggcgccttctacgagagaaagatcgtgaccaccgacctgagacagagatgcaccgacggccacaccggcaccagcgtgagcgcccccatggtggccggcatcatcgccctggccctggaggccaacagccagctgacctggagagacgtgcagcacctgctggtgaagaccagcagacccgcccacctgaaggccagcgactggaaggtgaacggcgccggccacaaggtgagccacttctacggcttcggcctggtggacgccgaggccctggtggtggaggccaagaagtggaccgccgtgcccagccagcacatgtgcgtggccgccagcgacaagagacccagaagcatccccctggtgcaggtgctgagaaccaccgccctgaccagcgcctgcgccgagcacagcgaccagagagtggtgtacctggagcacgtggtggtgagaaccagcatcagccaccccagaagaggcgacctgcagatctacctggtgagccccagcggcaccaagagccagctgctggccaagagactgctggacctgagcaacgagggcttcaccaactgggagttcatgaccgtgcactgctggggcgagaaggccgagggccagtggaccctggagatccaggacctgcccagccaggtgagaaaccccgagaagcagggcgacctggagacccccgtggccaaccagctgaccaccgaggagagagagcccggcctgaagcacgtgttcagatggcagatcgagcaggagctgtggtag

SEQ ID NO: 94775 - DNA, 2907 bp, Artificial Sequence
  Description of Artificial Sequence: Synthetic coding sequence
atgccccccagagccccccccgcccccggccccagacccccccccagagccgccgccgccaccgacaccgccgccggcgccggcggcgccggcggcgccggcggcgccggcggccccggcttcagacccctggcccccagaccctggagatggctgctgctgctggccctgcccgccgcctgcagccccccccccagacccgtgtacaccaaccactgggccgtgcaggtgctgggcggccccgccgaggccgacagagtggccgccgcccacggctacctgaacctgggccagatcggcaacctggaggactactaccacttctaccacagcaagaccttcaagagaagcaccctgagcagcagaggcccccacaccttcctgagaatggacccccaggtgaagtggctgcagcagcaggaggtgaagagaagagtgaagagacaggtgagaagcgacccccaggccctgtacttcaacgaccccatctggagcaacatgtggtacctgcactgcggcgacaagaacagcagatgcagaagcgagatgaacgtgcaggccgcctggaagagaggctacaccggcaagaacgtggtggtgaccatcctggacgacggcatcgagagaaaccaccccgacctggcccccaactacgacagctacgccagctacgacgtgaacggcaacgactacgaccccagccccagatacgacgccagcaacgagaacaagcacggcaccagatgcgccggcgaggtggccgccagcgccaacaacagctactgcatcgtgggcatcgcctacaacgccaagatcggcggcatcagaatgctggacggcgacgtgaccgacgtggtggaggccaagagcctgggcatcagacccaactacatcgacatctacagcgccagctggggccccgacgacgacggcaagaccgtggacggccccggcagactggccaagcaggccttcgagtacggcatcaagaagggcagacagggcctgggcagcatcttcgtgtgggccagcggcaacggcggcagagagggcgactactgcagctgcgacggctacaccaacagcatctacaccatcagcgtgagcagcgccaccgagaacggctacaagccctggtacctggaggagtgcgccagcaccctggccaccacctacagcagcggcgccttctacgagagaaagatcgtgaccaccgacctgagacagagatgcaccgacggccacaccggcaccagcgtgagcgcccccatggtggccggcatcatcgccctggccctggaggccaacagccagctgacctggagagacgtgcagcacctgctggtgaagaccagcagacccgcccacctgaaggccagcgactggaaggtgaacggcgccggccacaaggtgagccacttctacggcttcggcctggtggacgccgaggccctggtggtggaggccaagaagtggaccgccgtgcccagccagcacatgtgcgtggccgccagcgacaagagacccagaagcatccccctggtgcaggtgctgagaaccaccgccctgaccagcgcctgcgccgagcacagcgaccagagagtggtgtacctggagcacgtggtggtgagaaccagcatcagccaccccagaagaggcgacctgcagatctacctggtgagccccagcggcaccaagagccagctgctggccaagagactgctggacctgagcaacgagggcttcaccaactgggagttcatgaccgtgcactgctggggcgagaaggccgagggccagtggaccctggagatccaggacctgcccagccaggtgagaaaccccgagaagcagggcaagctgaaggagtggagcctgatcctgtacggcaccgccgagcacccctaccacaccttcagcgcccaccagagcagaagcagaatgctggagctgagcgcccccgagctggagccccccaaggccgccctgagccccagccaggtggaggtgcccgaggacgaggaggactacaccgcccagagcacccccggcagcgccaacatcctgcagaccagcgtgtgccaccccgagtgcggcgacaagggctgcgacggccccaacgccgaccagtgcctgaactgcgtgcacttcagcctgggcagcgtgaagaccagcagaaagtgcgtgagcgtgtgccccctgggctacttcggcgacaccgccgccagaagatgcagaagatgccacaagggctgcgagacctgcagcagcagagccgccacccagtgcctgagctgcagaagaggcttctaccaccaccaggagatgaacacctgcgtgaccctgtgccccgccggcttctacgccgacgagagccagaagaactgcctgaagtgccaccccagctgcaagaagtgcgtggacgagcccgagaagtgcaccgtgtgcaaggagggcttcagcctggccagaggcagctgcatccccgactgcgagcccggcacctacttcgacagcgagctgatcagatgcggcgagtgccaccacacctgcggcacctgcgtgggccccggcagagaggagtgcatccactgcgccaagaacttccacttccacgactggaagtgcgtgcccgcctgcggcgagggcttctaccccgaggagatgcccggcctgccccacaaggtgtgcagaagatgcgacgagaactgcctgagctgcgccggcagcagcagaaactgcagcagatgcaagaccggcttcacccagctgggcaccagctgcatcaccaaccacacctgcagcaacgccgacgagaccttctgcgagatggtgaagagcaacagactgtgcgagagaaagctgttcatccagttctgctgcagaacctgcctgctggccggctag

SEQ ID NO: 94776 - DNA, 2868 bp, Artificial Sequence
  Description of Artificial Sequence: Synthetic coding sequence
atgccccccagagccccccccgcccccggccccagacccccccccagagccgccgccgccaccgacaccgccgccggcgccggcggcgccggcggcgccggcggcgccggcggccccggcttcagacccctggcccccagaccctggagatggctgctgctgctggccctgcccgccgcctgcagccccccccccagacccgtgtacaccaaccactgggccgtgcaggtgctgggcggccccgccgaggccgacagagtggccgccgcccacggctacctgaacctgggccagatcggcaacctggaggactactaccacttctaccacagcaagaccttcaagagaagcaccctgagcagcagaggcccccacaccttcctgagaatggacccccaggtgaagtggctgcagcagcaggaggtgaagagaagagtgaagagacaggtgagaagcgacccccaggccctgtacttcaacgaccccatctggagcaacatgtggtacctgcactgcggcgacaagaacagcagatgcagaagcgagatgaacgtgcaggccgcctggaagagaggctacaccggcaagaacgtggtggtgaccatcctggacgacggcatcgagagaaaccaccccgacctggcccccaactacgacagctacgccagctacgacgtgaacggcaacgactacgaccccagccccagatacgacgccagcaacgagaacaagcacggcaccagatgcgccggcgaggtggccgccagcgccaacaacagctactgcatcgtgggcatcgcctacaacgccaagatcggcggcatcagaatgctggacggcgacgtgaccgacgtggtggaggccaagagcctgggcatcagacccaactacatcgacatctacagcgccagctggggccccgacgacgacggcaagaccgtggacggccccggcagactggccaagcaggccttcgagtacggcatcaagaagggcagacagggcctgggcagcatcttcgtgtgggccagcggcaacggcggcagagagggcgactactgcagctgcgacggctacaccaacagcatctacaccatcagcgtgagcagcgccaccgagaacggctacaagccctggtacctggaggagtgcgccagcaccctggccaccacctacagcagcggcgccttctacgagagaaagatcgtgaccaccgacctgagacagagatgcaccgacggccacaccggcaccagcgtgagcgcccccatggtggccggcatcatcgccctggccctggaggccaacagccagctgacctggagagacgtgcagcacctgctggtgaagaccagcagacccgcccacctgaaggccagcgactggaaggtgaacggcgccggccacaaggtgagccacttctacggcttcggcctggtggacgccgaggccctggtggtggaggccaagaagtggaccgccgtgcccagccagcacatgtgcgtggccgccagcgacaagagacccagaagcatccccctggtgcaggtgctgagaaccaccgccctgaccagcgcctgcgccgagcacagcgaccagagagtggtgtacctggagcacgtggtggtgagaaccagcatcagccaccccagaagaggcgacctgcagatctacctggtgagccccagcggcaccaagagccagctgctggccaagagactgctggacctgagcaacgagggcttcaccaactgggagttcatgaccgtgcactgctggggcgagaaggccgagggccagtggaccctggagatccaggacctgcccagccaggtgagaaaccccgagaagcagggcaagctgaaggagtggagcctgatcctgtacggcaccgccgagcacccctaccacaccttcagcgcccaccagagcagaagcagaatgctggagctgagcgcccccgagctggagccccccaaggccgccctgagccccagccaggtggaggtgcccgaggacgaggaggactacaccggcgtgtgccaccccgagtgcggcgacaagggctgcgacggccccaacgccgaccagtgcctgaactgcgtgcacttcagcctgggcagcgtgaagaccagcagaaagtgcgtgagcgtgtgccccctgggctacttcggcgacaccgccgccagaagatgcagaagatgccacaagggctgcgagacctgcagcagcagagccgccacccagtgcctgagctgcagaagaggcttctaccaccaccaggagatgaacacctgcgtgaccctgtgccccgccggcttctacgccgacgagagccagaagaactgcctgaagtgccaccccagctgcaagaagtgcgtggacgagcccgagaagtgcaccgtgtgcaaggagggcttcagcctggccagaggcagctgcatccccgactgcgagcccggcacctacttcgacagcgagctgatcagatgcggcgagtgccaccacacctgcggcacctgcgtgggccccggcagagaggagtgcatccactgcgccaagaacttccacttccacgactggaagtgcgtgcccgcctgcggcgagggcttctaccccgaggagatgcccggcctgccccacaaggtgtgcagaagatgcgacgagaactgcctgagctgcgccggcagcagcagaaactgcagcagatgcaagaccggcttcacccagctgggcaccagctgcatcaccaaccacacctgcagcaacgccgacgagaccttctgcgagatggtgaagagcaacagactgtgcgagagaaagctgttcatccagttctgctgcagaacctgcctgctggccggctag

SEQ ID NO: 94777 - DNA, 1869 bp, Artificial Sequence
  Description of Artificial Sequence: Synthetic coding sequence
atgccccccagagccccccccgcccccggccccagacccccccccagagccgccgccgccaccgacaccgccgccggcgccggcggcgccggcggcgccggcggcgccggcggccccggcttcagacccctggcccccagaccctggagatggctgctgctgctggccctgcccgccgcctgcagcgccccccccagacccgtgtacaccaaccactgggccgtgcaggtgctgggcggccccgccgaggccgacagagtggccgccgcccacggctacctgaacctgggccagatcggcaacctggaggactactaccacttctaccacagcaagaccttcaagagaagcaccctgagcagcagaggcccccacaccttcctgagaatggacccccaggtgaagtggctgcagcagcaggaggtgaagagaagagtgaagagacaggtgagaagcgacccccaggccctgtacttcaacgaccccatctggagcaacatgtggtacctgcactgcggcgacaagaacagcagatgcagaagcgagatgaacgtgcaggccgcctggaagagaggctacaccggcaagaacgtggtggtgaccatcctggacgacggcatcgagagaaaccaccccgacctggcccccaactacgacagctacgccagctacgacgtgaacggcaacgactacgaccccagccccagatacgacgccagcaacgagaacaagcacggcaccagatgcgccggcgaggtggccgccagcgccaacaacagctactgcatcgtgggcatcgcctacaacgccaagatcggcggcatcagaatgctggacggcgacgtgaccgacgtggtggaggccaagagcctgggcatcagacccaactacatcgacatctacagcgccagctggggccccgacgacgacggcaagaccgtggacggccccggcagactggccaagcaggccttcgagtacggcatcaagaagggcagacagggcctgggcagcatcttcgtgtgggccagcggcaacggcggcagagagggcgactactgcagctgcgacggctacaccaacagcatctacaccatcagcgtgagcagcgccaccgagaacggctacaagccctggtacctggaggagtgcgccagcaccctggccaccacctacagcagcggcgccttctacgagagaaagatcgtgaccaccgacctgagacagagatgcaccgacggccacaccggcaccagcgtgagcgcccccatggtggccggcatcatcgccctggccctggaggccaacagccagctgacctggagagacgtgcagcacctgctggtgaagaccagcagacccgcccacctgaaggccagcgactggaaggtgaacggcgccggccacaaggtgagccacttctacggcttcggcctggtggacgccgaggccctggtggtggaggccaagaagtggaccgccgtgcccagccagcacatgtgcgtggccgccagcgacaagagacccagaagcatccccctggtgcaggtgctgagaaccaccgccctgaccagcgcctgcgccgagcacagcgaccagagagtggtgtacctggagcacgtggtggtgagaaccagcatcagccaccccagaagaggcgacctgcagatctacctggtgagccccagcggcaccaagagccagctgctggccaagagactgctggacctgagcaacgagggcttcaccaactgggagttcatgaccgtgcactgctggggcgagaaggccgagggccagtggaccctggagatccaggacctgcccagccaggtgagaaaccccgagaagcagggcaacctggactag

SEQ ID NO: 94778 - DNA, 1584 bp, Artificial Sequence
  Description of Artificial Sequence: Synthetic coding sequence
atgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgagcgccgagcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94779 - DNA, 1680 bp, Artificial Sequence
  Description of Artificial Sequence: Synthetic coding sequence
atgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggatcggctgctggggcgtgggcgtgggcagctgcctgtggcccacctgggcccccaccctgctgagcaccagcggctgccaggagaccgccagcaaggccagcagaacctag

SEQ ID NO: 94780 - DNA, 723 bp, Artificial Sequence
  Description of Artificial Sequence: Synthetic coding sequence
atgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94781 - DNA, 1581 bp, Artificial Sequence
  Description of Artificial Sequence: Synthetic coding sequence
atgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgctgcagcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94782 - DNA, 1575 bp, Artificial Sequence
  Description of Artificial Sequence: Synthetic coding sequence
atgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94783 - DNA, 1353 bp, Artificial Sequence
  Description of Artificial Sequence: Synthetic coding sequence
atgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgcagcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94784 - DNA, 1593 bp, Artificial Sequence
  Description of Artificial Sequence: Synthetic coding sequence
gacggcgccatgtacgccctgttcctgctggccagcctgctgggcgccgccctggccggccccgtgctgggcctgaaggagtgcaccagaggcagcgccgtgtggtgccagaacgtgaagaccgccagcgactgcggcgccgtgaagcactgcctgcagaccgtgtggaacaagcccaccgtgaagagcctgccctgcgacatctgcaaggacgtggtgaccgccgccggcgacatgctgaaggacaacgccaccgaggaggagatcctggtgtacctggagaagacctgcgactggctgcccaagcccaacatgagcgccagctgcaaggagatcgtggacagctacctgcccgtgatcctggacatcatcaagggcgagatgagcagacccggcgaggtgtgcagcgccctgaacctgtgcgagagcctgcagaagcacctggccgagctgaaccaccagaagcagctggagagcaacaagatccccgagctggacatgaccgaggtggtggcccccttcatggccaacatccccctgctgctgtacccccaggacggccccagaagcaagccccagcccaaggacaacggcgacgtgtgccaggactgcatccagatggtgaccgacatccagaccgccgtgagaaccaacagcaccttcgtgcaggccctggtggagcacgtgaaggaggagtgcgacagactgggccccggcatggccgacatctgcaagaactacatcagccagtacagcgagatcgccatccagatgatgatgcacatgagcgccgagcagcccaaggagatctgcgccctggtgggcttctgcgacgaggtgaaggagatgcccatgcagaccctggtgcccgccaaggtggccagcaagaacgtgatccccgccctggagctggtggagcccatcaagaagcacgaggtgcccgccaagagcgacgtgtactgcgaggtgtgcgagttcctggtgaaggaggtgaccaagctgatcgacaacaacaagaccgagaaggagatcctggacgccttcgacaagatgtgcagcaagctgcccaagagcctgagcgaggagtgccaggaggtggtggacacctacggcagcagcatcctgagcatcctgctggaggaggtgagccccgagctggtgtgcagcatgctgcacctgtgcagcggcaccagactgcccgccctgaccgtgcacgtgacccagcccaaggacggcggcttctgcgaggtgtgcaagaagctggtgggctacctggacagaaacctggagaagaacagcaccaagcaggagatcctggccgccctggagaagggctgcagcttcctgcccgacccctaccagaagcagtgcgaccagttcgtggccgagtacgagcccgtgctgatcgagatcctggtggaggtgatggaccccagcttcgtgtgcctgaagatcggcgcctgccccagcgcccacaagcccctgctgggcaccgagaagtgcatctggggccccagctactggtgccagaacaccgagaccgccgcccagtgcaacgccgtggagcactgcaagagacacgtgtggaactag

SEQ ID NO: 94785 - DNA, 2214 bp, Artificial Sequence
  Description of Artificial Sequence: Synthetic coding sequence
atgcccgaccacgacagcaccgccctgctgagcagacagaccaagagaagaagagtggacatcggcgtgaagagaaccgtgggcaccgccagcgccttcttcgccaaggccagagccaccttcttcagcgccatgaacccccagggcagcgagcaggacgtggagtacagcgtggtgcagcacgccgacggcgagaagagcaacgtgctgagaaagctgctgaagagagccaacagctacgaggacgccatgatgcccttccccggcgccaccatcatcagccagctgctgaagaacaacatgaacaagaacggcggcaccgagcccagcttccaggccagcggcctgagcagcaccggcagcgaggtgcaccaggaggacatctgcagcaacagcagcagagacagcccccccgagtgcctgagccccttcggcagacccaccatgagccagttcgacatggacagactgtgcgacgagcacctgagagccaagagagccagagtggagaacatcatcagaggcatgagccacagccccagcgtggccctgagaggcaacgagaacgagagagagatggccccccagagcgtgagccccagagagagctacagagagaacaagagaaagcagaagctgccccagcagcagcagcagagcttccagcagctggtgagcgccagaaaggagcagaagagagaggagagaagacagctgaagcagcagctggaggacatgcagaagcagctgagacagctgcaggagaagttctaccagatctacgacagcaccgacagcgagaacgacgaggacggcaacctgagcgaggacagcatgagaagcgagatcctggacgccagagcccaggacagcgtgggcagaagcgacaacgagatgtgcgagctggaccccggccagttcatcgacagagccagagccctgatcagagagcaggagatggccgagaacaagcccaagagagagggcaacaacaaggagagagaccacggccccaacagcctgcagcccgagggcaagcacctggccgagaccctgaagcaggagctgaacaccgccatgagccaggtggtggacaccgtggtgaaggtgttcagcgccaagcccagcagacaggtgccccaggtgttcccccccctgcagatcccccaggccagattcgccgtgaacggcgagaaccacaacttccacaccgccaaccagagactgcagtgcttcggcgacgtgatcatccccaaccccctggacaccttcggcaacgtgcagatggccagcagcaccgaccagaccgaggccctgcccctggtggtgagaaagaacagcagcgaccagagcgccagcggccccgccgccggcggccaccaccagcccctgcaccagagccccctgagcgccaccaccggcttcaccaccagcaccttcagacaccccttccccctgcccctgatggcctaccccttccagagccccctgggcgcccccagcggcagcttcagcggcaaggacagagccagccccgagagcctggacctgaccagagacaccaccagcctgagaaccaagatgagcagccaccacctgagccaccacccctgcagccccgcccacccccccagcaccgccgagggcctgagcctgagcctgatcaagagcgagtgcggcgacctgcaggacatgagcgagatcagcccctacagcggcagcgccatgcaggagggcctgagccccaaccacctgaagaaggccaagctgatgttcttctacaccagataccccagcagcaacatgctgaagacctacttcagcgacgtgaagttcaacagatgcatcaccagccagctgatcaagtggttcagcaacttcagagagttctactacatccagatggagaagtacgccagacaggccatcaacgacggcgtgaccagcaccgaggagctgagcatcaccagagactgcgagctgtacagagccctgaacatgcactacaacaaggccaacgacttcgaggtgcccgagagattcctggaggtggcccagatcaccctgagagagttcttcaacgccatcatcgccggcaaggacgtggaccccagctggaagaaggccatctacaaggtgatctgcaagctggacagcgaggtgcccgagatcttcaagagccccaactgcctgcaggagctgctgcacgagtag

SEQ ID NO: 94786 - DNA, 2031 bp, Artificial Sequence
  Description of Artificial Sequence: Synthetic coding sequence
atgcccgaccacgacagcaccgccctgctgagcagacagaccaagagaagaagagtggacatcggcgtgaagagaaccgtgggcaccgccagcgccttcttcgccaaggccagagccaccttcttcagcgccatgaacccccagggcagcgagcaggacgtggagtacagcgtggtgcagcacgccgacggcgagaagagcaacgtgctgagaaagctgctgaagagagccaacagctacgaggacgccatgatgcccttccccggcgccaccatcatcagccagctgctgaagaacaacatgaacaagaacggcggcaccgagcccagcttccaggccagcggcctgagcagcaccggcagcgaggtgcaccaggaggacatctgcagcaacagcagcagagacagcccccccgagtgcctgagccccttcggcagacccaccatgagccagttcgacatggacagactgtgcgacgagcacctgagagccaagagagccagagtggagaacatcatcagaggcatgagccacagccccagcgtggccctgagaggcaacgagaacgagagagagatggccccccagagcgtgagccccagagagagctacagagagaacaagagaaagcagaagctgccccagcagcagcagcagagcttccagcagctggtgagcgccagaaaggagcagaagagagaggagagaagacagctgaagcagcagctggaggacatgcagaagcagctgagacagctgcaggagaagttctaccagatctacgacagcaccgacagcgagaacgacgaggacggcaacctgagcgaggacagcatgagaagcgagatcctggacgccagagcccaggacagcgtgggcagaagcgacaacgagatgtgcgagctggaccccggccagttcatcgacagagccagagccctgatcagagagcaggagatggccgagaacaagcccaagagagagggcaacaacaaggagagagaccacggccccaacagcctgcagcccgagggcaagcacctggccgagaccctgaagcaggagctgaacaccgccatgagccaggtggtggacaccgtggtgaaggtgttcagcgccaagcccagcagacaggtgccccaggtgttcccccccctgcagatcccccaggccagattcgccgtgaacggcgagaaccacaacttccacaccgccaaccagagactgcagtgcttcggcgacgtgatcatccccaaccccctggacaccttcggcaacgtgcagatggccagcagcaccgaccagaccgaggccctgcccctggtggtgagaaagaacagcagcgaccagagcgccagcggccccgccgccggcggccaccaccagcccctgcaccagagccccctgagcgccaccaccggcttcaccaccagcaccttcagacaccccttccccctgcccctgatggcctaccccttccagagccccctgggcgcccccagcggcagcttcagcggcaaggacagagccagccccgagagcctggacctgaccagagacaccaccagcctgagaaccaagatgagcagccaccacctgagccaccacccctgcagccccgcccacccccccagcaccgccgagggcctgagcctgagcctgatcaagagcgagtgcggcgacctgcaggacatgagcgagatcagcccctacagcggcagcgccatgcaggagggcctgagccccaaccacctgaagaaggccaagctgatgttcttctacaccagataccccagcagcaacatgctgaagacctacttcagcgacgtgaagttcaacagatgcatcaccagccagctgatcaagtggttcagcaacttcagagagttctactacatccagatggagaagtacgccagacaggccatcaacgacggcgtgaccagcaccgaggagctgagcatcaccagagactgcgagctgtacagagccctgaacatgcactacaacaaggccaacgacttcgagtag

SEQ ID NO: 94787 - DNA, 2214 bp, Artificial Sequence; identical to SEQ ID NO: 94785
  Description of Artificial Sequence: Synthetic coding sequence

SEQ ID NO: 94788 - DNA, 693 bp, Artificial Sequence
  Description of Artificial Sequence: Synthetic coding sequence
atgcccgaccacgacagcaccgccctgctgagcagacagaccaagagaagaagagtggacatcggcgtgaagagaaccgtgggcaccgccagcgccttcttcgccaaggccagagccaccttcttcagcgccatgaacccccagggcagcgagcaggacgtggagtacagcgtggtgcagcacgccgacggcgagaagagcaacgtgctgagaaagctgctgaagagagccaacagctacgaggacgccatgatgcccttccccggcgccaccatcatcagccagctgctgaagaacaacatgaacaagaacggcggcaccgagcccagcttccaggccagcggcctgagcagcaccggcagcgaggtgcaccaggaggacatctgcagcaacagcagcagagacagcccccccgagtgcctgagccccttcggcagacccaccatgagccagttcgacatggacagactgtgcgacgagcacctgagagccaagagagccagagtggagaacatcatcagaggcatgagccacagccccagcgtggccctgagaggcaacgagaacgagagagagatggccccccagagcgtgagccccagagagagctacagagagaacaagagaaagcagaagctgccccagcagcagcagcagagcttccagcagctggtgagcgccagaaaggagtag

SEQ ID NO: 94789 - DNA, 2214 bp, Artificial Sequence; identical to SEQ ID NO: 94785
  Description of Artificial Sequence: Synthetic coding sequence

SEQ ID NO: 94790 - DNA, 930 bp, Artificial Sequence
  Description of Artificial Sequence: Synthetic coding sequence
atggccagcagcaccgaccagaccgaggccctgcccctggtggtgagaaagaacagcagcgaccagagcgccagcggccccgccgccggcggccaccaccagcccctgcaccagagccccctgagcgccaccaccggcttcaccaccagcaccttcagacaccccttccccctgcccctgatggcctaccccttccagagccccctgggcgcccccagcggcagcttcagcggcaaggacagagccagccccgagagcctggacctgaccagagacaccaccagcctgagaaccaagatgagcagccaccacctgagccaccacccctgcagccccgcccacccccccagcaccgccgagggcctgagcctgagcctgatcaagagcgagtgcggcgacctgcaggacatgagcgagatcagcccctacagcggcagcgccatgcaggagggcctgagccccaaccacctgaagaaggccaagctgatgttcttctacaccagataccccagcagcaacatgctgaagacctacttcagcgacgtgaagttcaacagatgcatcaccagccagctgatcaagtggttcagcaacttcagagagttctactacatccagatggagaagtacgccagacaggccatcaacgacggcgtgaccagcaccgaggagctgagcatcaccagagactgcgagctgtacagagccctgaacatgcactacaacaaggccaacgacttcgaggtgcccgagagattcctggaggtggcccagatcaccctgagagagttcttcaacgccatcatcgccggcaaggacgtggaccccagctggaagaaggccatctacaaggtgatctgcaagctggacagcgaggtgcccgagatcttcaagagccccaactgcctgcaggagctgctgcacgagtag

SEQ ID NO: 94791 - DNA, 1080 bp, Artificial Sequence
  Description of Artificial Sequence: Synthetic coding sequence
atgaagagccccttctacagatgccagaacaccaccagcgtggagaagggcaacagcgccgtgatgggcggcgtgctgttcagcaccggcctgctgggcaacctgctggccctgggcctgctggccagaagcggcctgggctggtgcagcagaagacccctgagacccctgcccagcgtgttctacatgctggtgtgcggcctgaccgtgaccgacctgctgggcaagtgcctgctgagccccgtggtgctggccgcctacgcccagaacagaagcctgagagtgctggcccccgccctggacaacagcctgtgccaggccttcgccttcttcatgagcttcttcggcctgagcagcaccctgcagctgctggccatggccctggagtgctggctgagcctgggccaccccttcttctacagaagacacatcaccctgagactgggcgccctggtggcccccgtggtgagcgccttcagcctggccttctgcgccctgcccttcatgggcttcggcaagttcgtgcagtactgccccggcacctggtgcttcatccagatggtgcacgaggagggcagcctgagcgtgctgggctacagcgtgctgtacagcagcctgatggccctgctggtgctggccaccgtgctgtgcaacctgggcgccatgagaaacctgtacgccatgcacagaagactgcagagacaccccagaagctgcaccagagactgcgccgagcccagagccgacggcagagaggccagcccccagcccctggaggagctggaccacctgctgctgctggccctgatgaccgtgctgttcaccatgtgcagcctgcccgtgatctacagagcctactacggcgccttcaaggacgtgaaggagaagaacagaaccagcgaggaggccgaggacctgagagccctgagattcctgagcgtgatcagcatcgtggacccctggatcttcatcatcttcagaagccccgtgttcagaatcttcttccacaagatcttcatcagacccctgagatacagaagcagatgcagcaacagcaccaacatggagagcagcctgtag

SEQ ID NO: 94792 - DNA, 8034 bp, Artificial Sequence
  Description of Artificial Sequence: Synthetic coding sequence
atgagcacctgctgctggtgcacccccggcggcgccagcaccatcgacttcctgaagagatacgccagcaacacccccagcggcgagttccagaccgccgacgaggacctgtgctactgcctggagtgcgtggccgagtaccacaaggccagagacgagctgcccttcctgcacgaggtgctgtgggagctggagaccctgagactgatcaaccacttcgagaagagcatgaaggccgagatcggcgacgacgacgagctgtacatcgtggacaacaacggcgagatgcccctgttcgacatcaccggccaggacttcgagaacaagctgagagtgcccctgctggagatcctgaagtacccctacctgctgctgcacgagagagtgaacgagctgtgcgtggaggccctgtgcagaatggagcaggccaactgcagcttccaggtgttcgacaagcaccccggcatctacctgttcctggtgcaccccaacgagatggtgagaagatgggccatcctgaccgccagaaacctgggcaaggtggacagagacgactactacgacctgcaggaggtgctgctgtgcctgttcaaggtgatcgagctgggcctgctggagagccccgacatctacaccagcagcgtgctggagaagggcaagctgatcctgctgcccagccacatgtacgacaccaccaactacaagagctactggctgggcatctgcatgctgctgaccatcctggaggagcaggccatggacagcctgctgctgggcagcgacaagcagaacgacttcatgcagagcatcctgcacaccatggagagagaggccgacgacgacagcgtggaccccttctggcccgccctgcactgcttcatggtgatcctggacagactgggcagcaaggtgtggggccagctgatggaccccatcgtggccttccagaccatcatcaacaacgccagctacaacagagagatcagacacatcagaaacagcagcgtgagaaccaagctggagcccgagagctacctggacgacatggtgacctgcagccagatcgtgtacaactacaaccccgagaagaccaagaaggacagcggctggagaaccgccatctgccccgactactgccccaacatgtacgaggagatggagaccctggccagcgtgctgcagagcgacatcggccaggacatgagagtgcacaacagcaccttcctgtggttcatccccttcgtgcagagcctgatggacctgaaggacctgggcgtggcctacatcgcccaggtggtgaaccacctgtacagcgaggtgaaggaggtgctgaaccagaccgacgccgtgtgcgacaaggtgaccgagttcttcctgctgatcctggtgagcgtgatcgagctgcacagaaacaagaagtgcctgcacctgctgtgggtgagcagccagcagtgggtggaggccgtggtgaagtgcgccaagctgcccaccaccgccttcaccagaagcagcgagaagagcagcggcaactgcagcaagggcaccgccatgatcagcagcctgagcctgcacagcatgcccagcaacagcgtgcagctggcctacgtgcagctgatcagaagcctgctgaaggagggctaccagctgggccagcagagcctgtgcaagagattctgggacaagctgaacctgttcctgagaggcaacctgagcctgggctggcagctgaccagccaggagacccacgagctgcagagctgcctgaagcagatcatcagaaacatcaagttcaaggcccccccctgcaacaccttcgtggacctgaccagcgcctgcaagatcagccccgccagctacaacaaggaggagagcgagcagatgggcaagaccagcagaaaggacatgcactgcctggaggccagcagccccaccttcagcaaggagcccatgaaggtgcaggacagcgtgctgatcaaggccgacaacaccatcgagggcgacaacaacgagcagaactacatcaaggacgtgaagctggaggaccacctgctggccggcagctgcctgaagcagagcagcaagaacatcttcaccgagagagccgaggaccagatcaagatcagcaccagaaagcagaagagcgtgaaggagatcagcagctacacccccaaggactgcaccagcagaaacggccccgagagaggctgcgacagaggcatcatcgtgagcaccagactgctgaccgacagcagcaccgacgccctggagaaggtgagcaccagcaacgaggacttcagcctgaaggacgacgccctggccaagaccagcaagagaaagaccaaggtgcagaaggacgagatctgcgccaagctgagccacgtgatcaagaagcagcacagaaagagcaccctggtggacaacaccatcaacctggacgagaacctgaccgtgagcaacatcgagagcttctacagcagaaaggacaccggcgtgcagaagggcgacggcttcatccacaacctgagcctggaccccagcggcgtgctggacgacaagaacggcgagcagaagagccagaacaacgtgctgcccaaggagaagcagctgaagaacgaggagctggtgatcttcagcttccacgagaacaactgcaagatccaggagttccacgtggacggcaaggagctgatccccttcaccgagatgaccaacgccagcgagaagaagagcagccccttcaaggacctgatgaccgtgcccgagagcagagacgaggagatgagcaacagcaccagcgtgatctacagcaacctgaccagagagcaggcccccgacatcagccccaagagcgacaccctgaccgacagccagatcgacagagacctgcacaagctgagcctgctggcccaggccagcgtgatcaccttccccagcgacagcccccagaacagcagccagctgcagagaaaggtgaaggaggacaagagatgcttcaccgccaaccagaacaacgtgggcgacaccagcagaggccaggtgatcatcatcagcgacagcgacgacgacgacgacgagagaatcctgagcctggagaagctgaccaagcaggacaagatctgcctggagagagagcaccccgagcagcacgtgagcaccgtgaacagcaaggaggagaagaaccccgtgaaggaggagaagaccgagaccctgttccagttcgaggagagcgacagccagtgcttcgagttcgagagcagcagcgaggtgttcagcgtgtggcaggaccaccccgacgacaacaacagcgtgcaggacggcgagaagaagtgcctggcccccatcgccaacaccaccaacggccagggctgcaccgactacgtgagcgaggtggtgaagaagggcgccgagggcatcgaggagcacaccagacccagaagcatcagcgtggaggagttctgcgagatcgaggtgaagaagcccaagagaaagagaagcgagaagcccatggccgaggaccccgtgagacccagcagcagcgtgagaaacgagggccagagcgacaccaacaagagagacctggtgggcaacgacttcaagagcatcgacagaagaaccagcacccccaacagcagaatccagagagccaccaccgtgagccagaagaagagcagcaagctgtgcacctgcaccgagcccatcagaaaggtgcccgtgagcaagacccccaagaagacccacagcgacgccaagaagggccagaacagaagcagcaactacctgagctgcagaaccacccccgccatcgtgccccccaagaagttcagacagtgccccgagcccaccagcaccgccgagaagctgggcctgaagaagggccccagaaaggcctacgagctgagccagagaagcctggactacgtggcccagctgagagaccacggcaagaccgtgggcgtggtggacaccagaaagaagaccaagctgatcagcccccagaacctgagcgtgagaaacaacaagaagctgctgaccagccaggagctgcagatgcagagacagatcagacccaagagccagaagaacagaagaagactgagcgactgcgagagcaccgacgtgaagagagccggcagccacaccgcccagaacagcgacatcttcgtgcccgagagcgacagaagcgactacaactgcaccggcggcaccgaggtgctggccaacagcaacagaaagcagctgatcaagtgcatgcccagcgagcccgagaccatcaaggccaagcacggcagccccgccaccgacgacgcctgccccctgaaccagtgcgacagcgtggtgctgaacggcaccgtgcccaccaacgaggtgatcgtgagcaccagcgaggaccccctgggcggcggcgaccccaccgccagacacatcgagatggccgccctgaaggagggcgagcccgacagcagcagcgacgccgaggaggacaacctgttcctgacccagaacgaccccgaggacatggacctgtgcagccagatggagaacgacaactacaagctgatcgagctgatccacggcaaggacaccgtggaggtggaggaggacagcgtgagcagaccccagctggagagcctgagcggcaccaagtgcaagtacaaggactgcctggagaccaccaagaaccagggcgagtactgccccaagcacagcgaggtgaaggccgccgacgaggacgtgttcagaaagcccggcctgcccccccccgccagcaagcccctgagacccaccaccaagatcttcagcagcaagagcaccagcagaatcgccggcctgagcaagagcctggagaccagcagcgccctgagccccagcctgaagaacaagagcaagggcatccagagcatcctgaaggtgccccagcccgtgcccctgatcgcccagaagcccgtgggcgagatgaagaacagctgcaacgtgctgcacccccagagccccaacaacagcaacagacagggctgcaaggtgcccttcggcgagagcaagtacttccccagcagcagccccgtgaacatcctgctgagcagccagagcgtgagcgacaccttcgtgaaggaggtgctgaagtggaagtacgagatgttcctgaacttcggccagtgcggcccccccgccagcctgtgccagagcatcagcagacccgtgcccgtgagattccacaactacggcgactacttcaacgtgttcttccccctgatggtgctgaacaccttcgagaccgtggcccaggagtggctgaacagccccaacagagagaacttctaccagctgcaggtgagaaagttccccgccgactacatcaagtactgggagttcgccgtgtacctggaggagtgcgagctggccaagcagctgtaccccaaggagaacgacctggtgttcctggcccccgagagaatcaacgaggagaagaaggacaccgagagaaacgacatccaggacctgcacgagtaccacagcggctacgtgcacaagttcagaagaaccagcgtgatgagaaacggcaagaccgagtgctacctgagcatccagacccaggagaacttccccgccaacctgaacgagctggtgaactgcatcgtgatcagcagcctggtgaccacccagagaaagctgaaggccatgagcctgctgggcagcagaaaccagctggccagagccgtgctgaaccccaaccccatggacttctgcaccaaggacctgctgaccaccaccagcgagagaatcatcgcctacctgagagacttcaacgaggaccagaagaaggccatcgagaccgcctacgccatggtgaagcacagccccagcgtggccaagatctgcctgatccacggcccccccggcaccggcaagagcaagaccatcgtgggcctgctgtacagactgctgaccgagaaccagagaaagggccacagcgacgagaacagcaacgccaagatcaagcagaacagagtgctggtgtgcgcccccagcaacgccgccgtggacgagctgatgaagaagatcatcctggagttcaaggagaagtgcaaggacaagaagaaccccctgggcaactgcggcgacatcaacctggtgagactgggccccgagaagagcatcaacagcgaggtgctgaagttcagcctggacagccaggtgaaccacagaatgaagaaggagctgcccagccacgtgcaggccatgcacaagagaaaggagttcctggactaccagctggacgagctgagcagacagagagccctgtgcagaggcggcagagagatccagagacaggagctggacgagaacatcagcaaggtgagcaaggagagacaggagctggccagcaagatcaaggaggtgcagggcagaccccagaagacccagagcatcatcatcctggagagccacatcatctgctgcaccctgagcaccagcggcggcctgctgctggagagcgccttcagaggccagggcggcgtgcccttcagctgcgtgatcgtggacgaggccggccagagctgcgagatcgagaccctgacccccctgatccacagatgcaacaagctgatcctggtgggcgaccccaagcagctgccccccaccgtgatcagcatgaaggcccaggagtacggctacgaccagagcatgatggccagattctgcagactgctggaggagaacgtggagcacaacatgatcagcagactgcccatcctgcagctgaccgtgcagtacagaatgcaccccgacatctgcctgttccccagcaactacgtgtacaacagaaacctgaagaccaacagacagaccgaggccatcagatgcagcagcgactggcccttccagccctacctggtgttcgacgtgggcgacggcagcgagagaagagacaacgacagctacatcaacgtgcaggagatcaagctggtgatggagatcatcaagctgatcaaggacaagagaaaggacgtgagcttcagaaacatcggcatcatcacccactacaaggcccagaagaccatgatccagaaggacctggacaaggagttcgacagaaagggccccgccgaggtggacaccgtggacgccttccagggcagacagaaggactgcgtgatcgtgacctgcgtgagagccaacagcatccagggcagcatcggcttcctggccagcctgcagagactgaacgtgaccatcaccagagccaagtacagcctgttcatcctgggccacctgagaaccctgatggagaaccagcactggaaccagctgatccaggacgcccagaagagaggcgccatcatcaagacctgcgacaagaactacagacacgacgccgtgaagatcctgaagctgaagcccgtgctgcagagaagcctgacccacccccccaccatcgcccccgagggcagcagaccccagggcggcctgcccagcagcaagctggacagcggcttcgccaagaccagcgtggccgccagcctgtaccacacccccagcgacagcaaggagatcaccctgaccgtgaccagcaaggaccccgagagaccccccgtgcacgaccagctgcaggaccccagactgctgaagagaatgggcatcgaggtgaagggcggcatcttcctgtgggacccccagcccagcagcccccagcaccccggcgccaccccccccaccggcgagcccggcttccccgtggtgcaccaggacctgagccacatccagcagcccgccgccgtggtggccgccctgagcagccacaagccccccgtgagaggcgagccccccgccgccagccccgaggccagcacctgccagagcaagtgcgacgaccccgaggaggagctgtgccacagaagagaggccagagccttcagcgagggcgagcaggagaagtgcggcagcgagacccaccacaccagaagaaacagcagatgggacaagagaaccctggagcaggaggacagcagcagcaagaagagaaagctgctgtag

SEQ ID NO: 94793 - DNA, 483 bp, Artificial Sequence
  Description of Artificial Sequence: Synthetic coding sequence
atggccacccaccacaccctgtggatgggcctggccctgctgggcgtgctgggcgacctgcaggccgcccccgaggcccaggtgagcgtgcagcccaacttccagcaggacaagttcctgggcagatggttcagcgccggcctggccagcaacagcagctggctgagagagaagaaggccgccctgagcatgtgcaagagcgtggtggcccccgccaccgacggcggcctgaacctgaccagcaccttcctgagaaagaaccagtgcgagaccagaaccatgctgctgcagcccgccggcagcctgggcagctacagctacagaagccccagagagtggggcctgcacagaccccccggccccagcctgggcgccaccctggccggcaccaccctgggccagccccccgccgccgagatccacggcgtgggcggcgacggctgccccaccagcgtgagaggcaagggccaggcctgggcctag

SEQ ID NO: 94794 - DNA, 573 bp, Artificial Sequence
  Description of Artificial Sequence: Synthetic coding sequence
atggccacccaccacaccctgtggatgggcctggccctgctgggcgtgctgggcgacctgcaggccgcccccgaggcccaggtgagcgtgcagcccaacttccagcaggacaagttcctgggcagatggttcagcgccggcctggccagcaacagcagctggctgagagagaagaaggccgccctgagcatgtgcaagagcgtggtggcccccgccaccgacggcggcctgaacctgaccagcaccttcctgagaaagaaccagtgcgagaccagaaccatgctgctgcagcccgccggcagcctgggcagctacagctacagaagcccccactggggcagcacctacagcgtgagcgtggtggagaccgactacgaccagtacgccctgctgtacagccagggcagcaagggccccggcgaggacttcagaatggccaccctgtacagcagaacccagacccccagagccgagctgaaggagaagttcaccgccttctgcaaggcccagggcttcaccgaggacaccatcgtgttcctgccccagaccgacaagtgcatgaccgagcagtag

SEQ ID NO: 94795 - DNA, 189 bp, Artificial Sequence
  Description of Artificial Sequence: Synthetic coding sequence
tgaggctaccactgcctgcccgcccccaacagagcccagggcgaggtgggcggcgacggcggcagcgtgcagttcggcggcagcgtgaagaccagcagcgccctgagagaggagcaggaggcccagtgggagaactggcccaagagcggcgtgctgaccaccgcccccggcttcttcctgggcagatag

SEQ ID NO: 94796 - DNA, 642 bp, Artificial Sequence
  Description of Artificial Sequence: Synthetic coding sequence
tgactgagaggcggcggccagttcctgggcagaggcgtgagaggcgtggccgccagaggcatcggcagaggcggcggcgccggcctggagaccggcggcgtggacggcagaggcgcccccgccggcagaagaagatgggtgagaagagtgctggccgacgccggcggcggcagaagcccccagttcctgggcagatggttcagcgccggcctggccagcaacagcagctggctgagagagaagaaggccgccctgagcatgtgcaagagcgtggtggcccccgccaccgacggcggcctgaacctgaccagcaccttcctgagaaagaaccagtgcgagaccagaaccatgctgctgcagcccgccggcagcctgggcagctacagctacagaagcccccactggggcagcacctacagcgtgagcgtggtggagaccgactacgaccagtacgccctgctgtacagccagggcagcaagggccccggcgaggacttcagaatggccaccctgtacagcagaacccagacccccagagccgagctgaaggagaagttcaccgccttctgcaaggcccagggcttcaccgaggacaccatcgtgttcctgccccagaccgacaagtgcatgaccgagcagtag

SEQ ID NO: 94797 - DNA, 588 bp, Artificial Sequence
  Description of Artificial Sequence: Synthetic coding sequence
atggccacccaccacaccctgtggatgggcctggccctgctgggcgtgctgggcgacctgcaggccgcccccgaggcccaggtgagcgtgcagcccaacttccagcaggacaagttcctgggcagatggttcagcgccggcctggccagcaacagcagctggctgagagagaagaaggccgccctgagcatgtgcaagagcgtggtggcccccgccaccgacggcggcctgaacctgaccagcaccttcctgagaaagaaccagtgcgagaccagaaccatgctgctgcagcccgccggcagcctgggcagctacagctacagaagccccagagagtggggcctgcacagaccccccggccccagcctgggcgccaccctggccggcaccaccctgggccagccccccgccgccgagatccacggcgtgggcgactggggcagcacctacagcgtgagcgtggtggagaccgactacgaccagtacgccctgctgtacagccagggcagcaagggccccggcgaggacttcagaatggccaccctgtacagcagaacccagacccccagagccgagctgaaggagtag

SEQ ID NO: 94798 - DNA, 573 bp, Artificial Sequence; identical to SEQ ID NO: 94794
  Description of Artificial Sequence: Synthetic coding sequence

SEQ ID NO: 94799 - DNA, 1209 bp, Artificial Sequence
  Description of Artificial Sequence: Synthetic coding sequence
atgagcccctgcggccccctgaacctgagcctggccggcgaggccaccacctgcgccgccccctgggtgcccaacaccagcgccgtgccccccagcggcgccagccccgccctgcccatcttcagcatgaccctgggcgccgtgagcaacctgctggccctggccctgctggcccaggccgccggcagactgagaagaagaagaagcgccgccaccttcctgctgttcgtggccagcctgctggccaccgacctggccggccacgtgatccccggcgccctggtgctgagactgtacaccgccggcagagcccccgccggcggcgcctgccacttcctgggcggctgcatggtgttcttcggcctgtgccccctgctgctgggctgcggcatggccgtggagagatgcgtgggcgtgaccagacccctgctgcacgccgccagagtgagcgtggccagagccagactggccctggccgccgtggccgccgtggccctggccgtggccctgctgcccctggccagagtgggcagatacgagctgcagtaccccggcacctggtgcttcatcggcctgggcccccccggcggctggagacaggccctgctggccggcctgttcgccagcctgggcctggtggccctgctggccgccctggtgtgcaacaccctgagcggcctggccctgctgagagccagatggagaagaagaagcagaagacccccccccgccagcggccccgacagcagaagaagatggggcgcccacggccccagaagcgccagcgccagcagcgccagcagcatcgccagcgccagcaccttcttcggcggcagcagaagcagcggcagcgccagaagagccagagcccacgacgtggagatggtgggccagctggtgggcatcatggtggtgagctgcatctgctggagccccatgctggtgctggtggccctggccgtgggcggctggagcagcaccagcctgcagagacccctgttcctggccgtgagactggccagctggaaccagatcctggacccctgggtgtacatcctgctgagacaggccgtgctgagacagctgctgagactgctgccccccagagccggcgccaagggcggccccgccggcctgggcctgacccccagcgcctgggaggccagcagcctgagaagcagcagacacagcggcctgagccacttctag

SEQ ID NO: 94800 - DNA, 1077 bp, Artificial Sequence
  Description of Artificial Sequence: Synthetic coding sequence
atgggcaacgccagcaacgacagccagagcgaggactgcgagaccagacagtggctgccccccggcgagagccccgccatcagcagcgtgatgttcagcgccggcgtgctgggcaacctgatcgccctggccctgctggccagaagatggagaggcgacgtgggctgcagcgccggcagaagaagcagcctgagcctgttccacgtgctggtgaccgagctggtgttcaccgacctgctgggcacctgcctgatcagccccgtggtgctggccagctacgccagaaaccagaccctggtggccctggcccccgagagcagagcctgcacctacttcgccttcgccatgaccttcttcagcctggccaccatgctgatgctgttcgccatggccctggagagatacctgagcatcggccacccctacttctaccagagaagagtgagcagaagcggcggcctggccgtgctgcccgtgatctacgccgtgagcctgctgttctgcagcctgcccctgctggactacggccagtacgtgcagtactgccccggcacctggtgcttcatcagacacggcagaaccgcctacctgcagctgtacgccaccctgctgctgctgctgatcgtgagcgtgctggcctgcaacttcagcgtgatcctgaacctgatcagaatgcacagaagaagcagaagaagcagatgcggccccagcctgggcagcggcagaggcggccccggcgccagaagaagaggcgagagagtgagcatggccgaggagaccgaccacctgatcctgctggccatcatgaccatcaccttcgccgtgtgcagcctgcccttcaccatcttcgcctacatgaacgagaccagcagcagaaaggagaagtgggacctgcaggccctgagattcctgagcatcaacagcatcatcgacccctgggtgttcgccatcctgagaccccccgtgctgagactgatgagaagcgtgctgtgctgcagaatcagcctgagaacccaggacgccacccagaccagctgcagcacccagagcgacgccagcaagcaggccgacctgtag

SEQ ID NO: 94801 - DNA, 1173 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccagatcagataccacaccaacaactacgccagcagcagcaccagcctgccctgccagtgcagcagcaccctgatgtggagcgaccacctggagagatag

SEQ ID NO: 94802 - DNA, 1260 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccaggtggccaacgccgtgagcagctgcagcaacgacggccagaagggccagcccatcagcctgagcaacgagatcatccagaccgaggccatcagataccacaccaacaactacgccagcagcagcaccagcctgccctgccagtgcagcagcaccctgatgtggagcgaccacctggagagatag

SEQ ID NO: 94803 - DNA, 1290 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccagatgagaaagagaagactgagagagcagttctggagacccgccagcagcggcagcggctgccagcagatcagatgcctgatggagagctgcagcctgacccagaccggcgtgcagtggagcgacttcagaagcctgcagcccagccccccccccctgaccgccatcttcgccagctgggtgcaggtgatcctgctgccccagccccccaagtag

SEQ ID NO: 94804 - DNA, 1257 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccagatgagaaagagaagactgagagagcagctgatctgcagcctgcagaacagccagatccagagagccaccgcccactgcggccaggtgcagacctacagagtgctgaacagagaggagatggaggtgctggtgagcagcatcaacgtgtacaccagaatcagcaccgtgaagaccgagtag

SEQ ID NO: 94805 - DNA, 1209 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccagatgagaaagagaagactgagagagcaggagatgggccccgacggcagatgcttctgccacgcctggagacaggtgcccagaacctggtgcagcagccacgacagagagccctgcagcgtgcagctgagctag

SEQ ID NO: 94806 - DNA, 1167 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccaggtggccaacgccgtgagcagctgcagcaacgacggccagaagggccagcccatcagcctgagcaacgagatcatccagaccgaggcctag

SEQ ID NO: 94807 - DNA, 1173 bp, Artificial Sequence; identical to SEQ ID NO: 94801
  Description of Artificial Sequence: Synthetic coding sequence

SEQ ID NO: 94808 - DNA, 1098 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccaggaggagttctggggcaactag

SEQ ID NO: 94809 - DNA, 1365 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccaggtggccaacgccgtgagcagctgcagcaacgacggccagaagggccagcccatcagcctgagcaacgagatcatccagaccgaggccatgagaaagagaagactgagagagcaggcccccctgctgcccaccagcaccgtgatcgaccccagcagattctgcgcccagcccttcagatggttcctggacctgagcttccccgccatgagcagcagccacccccagctgcccctgaccctggccagcttcaagctgctgagagagccctgcagcgtgcagctgagctag

SEQ ID NO: 94810 - DNA, 1173 bp, Artificial Sequence; identical to SEQ ID NO: 94801
  Description of Artificial Sequence: Synthetic coding sequence

SEQ ID NO: 94811 - DNA, 1125 bp, Artificial Sequence
  Description of Artificial Sequence: Synthetic coding sequence
atgaaggagaccagaggctacggcggcgacgcccccttctgcaccagactgaaccacagctacaccggcatgtgggcccccgagagaagcgccgaggccagaggcaacctgaccagaccccccggcagcggcgaggactgcggcagcgtgagcgtggccttccccatcaccatgctgctgaccggcttcgtgggcaacgccctggccatgctgctggtgagcagaagctacagaagaagagagagcaagagaaagaagagcttcctgctgtgcatcggctggctggccctgaccgacctggtgggccagctgctgaccacccccgtggtgatcgtggtgtacctgagcaagcagagatgggagcacatcgaccccagcggcagactgtgcaccttcttcggcctgaccatgaccgtgttcggcctgagcagcctgttcatcgccagcgccatggccgtggagagagccctggccatcagagccccccactggtacgccagccacatgaagaccagagccaccagagccgtgctgctgggcgtgtggctggccgtgctggccttcgccctgctgcccgtgctgggcgtgggccagtacaccgtgcagtggcccggcacctggtgcttcatcagcaccggcagaggcggcaacggcaccagcagcagccacaactggggcaacctgttcttcgccagcgccttcgccttcctgggcctgctggccctgaccgtgaccttcagctgcaacctggccaccatcaaggccctggtgagcagatgcagagccaaggccaccgccagccagagcagcgcccagtggggcagaatcaccaccgagaccgccatccagctgatgggcatcatgtgcgtgctgagcgtgtgctggagccccctgctgatcatgatgctgaagatgatcttcaaccagaccagcgtggagcactgcaagacccacaccgagaagcagaaggagtgcaacttcttcctgatcgccgtgagactggccagcctgaaccagatcctggacccctgggtgtacctgctgctgagaaagatcctgctgagaaagttctgccagatgagaaagagaagactgagagagcaggaggagttctggggcaactag

SEQ ID NO: 94812 - DNA, 1467 bp, Artificial Sequence
  Description of Artificial Sequence: Synthetic coding sequence
atgagcacccccggcgtgaacagcagcgccagcctgagccccgacagactgaacagccccgtgaccatccccgccgtgatgttcatcttcggcgtggtgggcaacctggtggccatcgtggtgctgtgcaagagcagaaaggagcagaaggagaccaccttctacaccctggtgtgcggcctggccgtgaccgacctgctgggcaccctgctggtgagccccgtgaccatcgccacctacatgaagggccagtggcccggcggccagcccctgtgcgagtacagcaccttcatcctgctgttcttcagcctgagcggcctgagcatcatctgcgccatgagcgtggagagatacctggccatcaaccacgcctacttctacagccactacgtggacaagagactggccggcctgaccctgttcgccgtgtacgccagcaacgtgctgttctgcgccctgcccaacatgggcctgggcagcagcagactgcagtaccccgacacctggtgcttcatcgactggaccaccaacgtgaccgcccacgccgcctacagctacatgtacgccggcttcagcagcttcctgatcctggccaccgtgctgtgcaacgtgctggtgtgcggcgccctgctgagaatgcacagacagttcatgagaagaaccagcctgggcaccgagcagcaccacgccgccgccgccgccagcgtggccagcagaggccaccccgccgccagccccgccctgcccagactgagcgacttcagaagaagaagaagcttcagaagaatcgccggcgccgagatccagatggtgatcctgctgatcgccaccagcctggtggtgctgatctgcagcatccccctggtggtgagagtgttcgtgaaccagctgtaccagcccagcctggagagagaggtgagcaagaaccccgacctgcaggccatcagaatcgccagcgtgaaccccatcctggacccctggatctacatcctgctgagaaagaccgtgctgagcaaggccatcgagaagatcaagtgcctgttctgcagaatcggcggcagcagaagagagagaagcggccagcactgcagcgacagccagagaaccagcagcgccatgagcggccacagcagaagcttcatcagcagagagctgaaggagatcagcagcaccagccagaccctgctgcccgacctgagcctgcccgacctgagcgagaacggcctgggcggcagaaacctgctgcccggcgtgcccggcatgggcctggcccaggaggacaccaccagcctgagaaccctgagaatcagcgagaccagcgacagcagccagggccaggacagcgagagcgtgctgctggtggacgaggccggcggcagcggcagagccggccccgcccccaagggcagcagcctgcaggtgaccttccccagcgagaccctgaacctgagcgagaagtgcatctag

SEQ ID NO: 94813 - DNA, 459 bp, Artificial Sequence
  Description of Artificial Sequence: Synthetic coding sequence
atgcccgcccacagcctggtgatgagcagccccgccctgcccgccttcctgctgtgcagcaccctgctggtgatcaagatgtacgtggtggccatcatcaccggccaggtgagactgagaaagaaggccttcgccaaccccgaggacgccctgagacacggcggcccccagtactgcagaagcgaccccgacgtggagagatgcctgagagcccacagaaacgacatggagaccatctaccccttcctgttcctgggcttcgtgtacagcttcctgggccccaaccccttcgtggcctggatgcacttcctggtgttcctggtgggcagagtggcccacaccgtggcctacctgggcaagctgagagcccccatcagaagcgtgacctacaccctggcccagctgccctgcgccagcatggccctgcagatcctgtgggaggccgccagacacctgtag

SEQ ID NO: 94814 - DNA, 561 bp, Artificial Sequence
  Description of Artificial Sequence: Synthetic coding sequence
atgaaggccgtgaacgagcagggcaaggaggtgaccgagttcggcaacaagtactggctgatgctgaacgagaaggaggcccagcaggtgtacggcggcaaggaggccagaaccgaggagatgaagtggagacagtgggccgacgactggctggtgcacctgatcagccccaacgtgtacagaacccccaccgaggccctggccagcttcgactacatcgtgagagagggcaagttcggcgccgtggagggcgccgtggccaagtacatgggcgccgccgccatgtacctgatcagcaagagactgaagagcagacacagactgcaggacaacgtgagagaggacctgtacgaggccgccgacaagtgggtggccgccgtgggcaaggacagacccttcatgggcggccagaagcccaacctggccgacctggccgtgtacggcgtgctgagagtgatggagggcctggacgccttcgacgacctgatgcagcacacccacatccagccctggtacctgagagtggagagagccatcaccgaggccagccccgcccactag

SEQ ID NO: 94815 - DNA, 1134 bp, Artificial Sequence
  Description of Artificial Sequence: Synthetic coding sequence
atggaccccgccgccagagtggtgagagccctgtggcccggcggctgcgccctggcctggagactgggcggcagaccccagcccctgctgcccacccagagcagagccggcttcgccggcgccgccggcggccccagccccgtggccgccgccagaaagggcagccccagactgctgggcgccgccgccctggccctgggcggcgccctgggcctgtaccacaccgccagatggcacctgagagcccaggacctgcacgccgagagaagcgccgcccagctgagcctgagcagcagactgcagctgaccctgtaccagtacaagacctgccccttctgcagcaaggtgagagccttcctggacttccacgccctgccctaccaggtggtggaggtgaaccccgtgagaagagccgagatcaagttcagcagctacagaaaggtgcccatcctggtggcccaggagggcgagagcagccagcagctgaacgacagcagcgtgatcatcagcgccctgaagacctacctggtgagcggccagcccctggaggagatcatcacctactaccccgccatgaaggccgtgaacgagcagggcaaggaggtgaccgagttcggcaacaagtactggctgatgctgaacgagaaggaggcccagcaggtgtacggcggcaaggaggccagaaccgaggagatgaagtggagacagtgggccgacgactggctggtgcacctgatcagccccaacgtgtacagaacccccaccgaggccctggccagcttcgactacatcgtgagagagggcaagttcggcgccgtggagggcgccgtggccaagtacatgggcgccgccgccatgtacctgatcagcaagagactgaagagcagacacagactgcaggacaacgtgagagaggacctgtacgaggccgccgacaagtgggtggccgccgtgggcaaggacagacccttcatgggcggccagaagcccaacctggccgacctggccgtgtacggcgtgctgagagtgatggagggcctggacgccttcgacgacctgatgcagcacacccacatccagccctggtacctgagagtggagagagccatcaccgaggccagccccgcccactag

SEQ ID NO: 94816 - DNA, 894 bp, Artificial Sequence
  Description of Artificial Sequence: Synthetic coding sequence
atgagcatgaacaacagcaagcagctggtgagccccgccgccgccctgctgagcaacaccacctgccagaccgagaacagactgagcgtgttcttcagcgtgatcttcatgaccgtgggcatcctgagcaacagcctggccatcgccatcctgatgaaggcctaccagagattcagacagaagagcaaggccagcttcctgctgctggccagcggcctggtgatcaccgacttcttcggccacctgatcaacggcgccatcgccgtgttcgtgtacgccagcgacaaggagtggatcagattcgaccagagcaacgtgctgtgcagcatcttcggcatctgcatggtgttcagcggcctgtgccccctgctgctgggcagcgtgatggccatcgagagatgcatcggcgtgaccaagcccatcttccacagcaccaagatcaccagcaagcacgtgaagatgatgctgagcggcgtgtgcctgttcgccgtgttcatcgccctgctgcccatcctgggccacagagactacaagatccaggccagcagaacctggtgcttctacaacaccgaggacatcaaggactgggaggacagattctacctgctgctgttcagcttcctgggcctgctggccctgggcgtgagcctgctgtgcaacgccatcaccggcatcaccctgctgagagtgaagttcaagagccagcagcacagacagggcagaagccaccacctggagatggtgatccagctgctggccatcatgtgcgtgagctgcatctgctggagccccttcctgggctacagaatcatcctgaacggcaaggagaagtacaaggtgtacgaggagcagagcgacttcctgcacagactgcagtggcccaccctggagtag

SEQ ID NO: 94817 - DNA, 1080 bp, Artificial Sequence
  Description of Artificial Sequence: Synthetic coding sequence
atgagcatgaacaacagcaagcagctggtgagccccgccgccgccctgctgagcaacaccacctgccagaccgagaacagactgagcgtgttcttcagcgtgatcttcatgaccgtgggcatcctgagcaacagcctggccatcgccatcctgatgaaggcctaccagagattcagacagaagagcaaggccagcttcctgctgctggccagcggcctggtgatcaccgacttcttcggccacctgatcaacggcgccatcgccgtgttcgtgtacgccagcgacaaggagtggatcagattcgaccagagcaacgtgctgtgcagcatcttcggcatctgcatggtgttcagcggcctgtgccccctgctgctgggcagcgtgatggccatcgagagatgcatcggcgtgaccaagcccatcttccacagcaccaagatcaccagcaagcacgtgaagatgatgctgagcggcgtgtgcctgttcgccgtgttcatcgccctgctgcccatcctgggccacagagactacaagatccaggccagcagaacctggtgcttctacaacaccgaggacatcaaggactgggaggacagattctacctgctgctgttcagcttcctgggcctgctggccctgggcgtgagcctgctgtgcaacgccatcaccggcatcaccctgctgagagtgaagttcaagagccagcagcacagacagggcagaagccaccacctggagatggtgatccagctgctggccatcatgtgcgtgagctgcatctgctggagccccttcctggtgaccatggccaacatcggcatcaacggcaaccacagcctggagacctgcgagaccaccctgttcgccctgagaatggccacctggaaccagatcctggacccctgggtgtacatcctgctgagaaaggccgtgctgaagaacctgtacaagctggccagccagtgctgcggcgtgcacgtgatcagcctgcacatctgggagctgagcagcatcaagaacagcctgaaggtggccgccatcagcgagagccccgtggccgagaagagcgccagcacctag

SEQ ID NO: 94818 - DNA, 1080 bp, Artificial Sequence; identical to SEQ ID NO: 94817
  Description of Artificial Sequence: Synthetic coding sequence

SEQ ID NO: 94819 - DNA, 2640 bp, Artificial Sequence
  Description of Artificial Sequence: Synthetic coding sequence
atgggcagactggccagcagacccctgctgctggccctgctgagcctggccctgtgcagaggcagagtggtgagagtgcccaccgccaccctggtgagagtggtgggcaccgagctggtgatcccctgcaacgtgagcgactacgacggccccagcgagcagaacttcgactggagcttcagcagcctgggcagcagcttcgtggagctggccagcacctgggaggtgggcttccccgcccagctgtaccaggagagactgcagagaggcgagatcctgctgagaagaaccgccaacgacgccgtggagctgcacatcaagaacgtgcagcccagcgaccagggccactacaagtgcagcacccccagcaccgacgccaccgtgcagggcaactacgaggacaccgtgcaggtgaaggtgctggccgacagcctgcacgtgggccccagcgccagacccccccccagcctgagcctgagagagggcgagcccttcgagctgagatgcaccgccgccagcgccagccccctgcacacccacctggccctgctgtgggaggtgcacagaggccccgccagaagaagcgtgctggccctgacccacgagggcagattccaccccggcctgggctacgagcagagataccacagcggcgacgtgagactggacaccgtgggcagcgacgcctacagactgagcgtgagcagagccctgagcgccgaccagggcagctacagatgcatcgtgagcgagtggatcgccgagcagggcaactggcaggagatccaggagaaggccgtggaggtggccaccgtggtgatccagcccagcgtgctgagagccgccgtgcccaagaacgtgagcgtggccgagggcaaggagctggacctgacctgcaacatcaccaccgacagagccgacgacgtgagacccgaggtgacctggagcttcagcagaatgcccgacagcaccctgcccggcagcagagtgctggccagactggacagagacagcctggtgcacagcagcccccacgtggccctgagccacgtggacgccagaagctaccacctgctggtgagagacgtgagcaaggagaacagcggctactactactgccacgtgagcctgtgggcccccggccacaacagaagctggcacaaggtggccgaggccgtgagcagccccgccggcgtgggcgtgacctggctggagcccgactaccaggtgtacctgaacgccagcaaggtgcccggcttcgccgacgaccccaccgagctggcctgcagagtggtggacaccaagagcggcgaggccaacgtgagattcaccgtgagctggtactacagaatgaacagaagaagcgacaacgtggtgaccagcgagctgctggccgtgatggacggcgactggaccctgaagtacggcgagagaagcaagcagagagcccaggacggcgacttcatcttcagcaaggagcacaccgacaccttcaacttcagaatccagagaaccaccgaggaggacagaggcaactactactgcgtggtgagcgcctggaccaagcagagaaacaacagctgggtgaagagcaaggacgtgttcagcaagcccgtgaacatcttctgggccctggaggacagcgtgctggtggtgaaggccagacagcccaagcccttcttcgccgccggcaacaccttcgagatgacctgcaaggtgagcagcaagaacatcaagagccccagatacagcgtgctgatcatggccgagaagcccgtgggcgacctgagcagccccaacgagaccaagtacatcatcagcctggaccaggacagcgtggtgaagctggagaactggaccgacgccagcagagtggacggcgtggtgctggagaaggtgcaggaggacgagttcagatacagaatgtaccagacccaggtgagcgacgccggcctgtacagatgcatggtgaccgcctggagccccgtgagaggcagcctgtggagagaggccgccaccagcctgagcaaccccatcgagatcgacttccagaccagcggccccatcttcaacgccagcgtgcacagcgacacccccagcgtgatcagaggcgacctgatcaagctgttctgcatcatcaccgtggagggcgccgccctggaccccgacgacatggccttcgacgtgagctggttcgccgtgcacagcttcggcctggacaaggcccccgtgctgctgagcagcctggacagaaagggcatcgtgaccaccagcagaagagactggaagagcgacctgagcctggagagagtgagcgtgctggagttcctgctgcaggtgcacggcagcgaggaccaggacttcggcaactactactgcagcgtgaccccctgggtgaagagccccaccggcagctggcagaaggaggccgagatccacagcaagcccgtgttcatcaccgtgaagatggacgtgctgaacgccttcaagtaccccctgctgatcggcgtgggcctgagcaccgtgatcggcctgctgagctgcctgatcggctactgcagcagccactggtgctgcaagaaggaggtgcaggagaccagaagagagagaagaagactgatgagcatggagatggactag

SEQ ID NO: 94820 - DNA, 2217 bp, Artificial Sequence
  Description of Artificial Sequence: Synthetic coding sequence
agcggcgccgccggcgccggcagaggcggcggcggcgaggccgccggcaaggaggaggagggcgagcccttcgagctgagatgcaccgccgccagcgccagccccctgcacacccacctggccctgctgtgggaggtgcacagaggccccgccagaagaagcgtgctggccctgacccacgagggcagattccaccccggcctgggctacgagcagagataccacagcggcgacgtgagactggacaccgtgggcagcgacgcctacagactgagcgtgagcagagccctgagcgccgaccagggcagctacagatgcatcgtgagcgagtggatcgccgagcagggcaactggcaggagatccaggagaaggccgtggaggtggccaccgtggtgatccagcccagcgtgctgagagccgccgtgcccaagaacgtgagcgtggccgagggcaaggagctggacctgacctgcaacatcaccaccgacagagccgacgacgtgagacccgaggtgacctggagcttcagcagaatgcccgacagcaccctgcccggcagcagagtgctggccagactggacagagacagcctggtgcacagcagcccccacgtggccctgagccacgtggacgccagaagctaccacctgctggtgagagacgtgagcaaggagaacagcggctactactactgccacgtgagcctgtgggcccccggccacaacagaagctggcacaaggtggccgaggccgtgagcagccccgccggcgtgggcgtgacctggctggagcccgactaccaggtgtacctgaacgccagcaaggtgcccggcttcgccgacgaccccaccgagctggcctgcagagtggtggacaccaagagcggcgaggccaacgtgagattcaccgtgagctggtactacagaatgaacagaagaagcgacaacgtggtgaccagcgagctgctggccgtgatggacggcgactggaccctgaagtacggcgagagaagcaagcagagagcccaggacggcgacttcatcttcagcaaggagcacaccgacaccttcaacttcagaatccagagaaccaccgaggaggacagaggcaactactactgcgtggtgagcgcctggaccaagcagagaaacaacagctgggtgaagagcaaggacgtgttcagcaagcccgtgaacatcttctgggccctggaggacagcgtgctggtggtgaaggccagacagcccaagcccttcttcgccgccggcaacaccttcgagatgacctgcaaggtgagcagcaagaacatcaagagccccagatacagcgtgctgatcatggccgagaagcccgtgggcgacctgagcagccccaacgagaccaagtacatcatcagcctggaccaggacagcgtggtgaagctggagaactggaccgacgccagcagagtggacggcgtggtgctggagaaggtgcaggaggacgagttcagatacagaatgtaccagacccaggtgagcgacgccggcctgtacagatgcatggtgaccgcctggagccccgtgagaggcagcctgtggagagaggccgccaccagcctgagcaaccccatcgagatcgacttccagaccagcggccccatcttcaacgccagcgtgcacagcgacacccccagcgtgatcagaggcgacctgatcaagctgttctgcatcatcaccgtggagggcgccgccctggaccccgacgacatggccttcgacgtgagctggttcgccgtgcacagcttcggcctggacaaggcccccgtgctgctgagcagcctggacagaaagggcatcgtgaccaccagcagaagagactggaagagcgacctgagcctggagagagtgagcgtgctggagttcctgctgcaggtgcacggcagcgaggaccaggacttcggcaactactactgcagcgtgaccccctgggtgaagagccccaccggcagctggcagaaggaggccgagatccacagcaagcccgtgttcatcaccgtgaagatggacgtgctgaacgccttcaagtaccccctgctgatcggcgtgggcctgagcaccgtgatcggcctgctgagctgcctgatcggctactgcagcagccactggtgctgcaagaaggaggtgcaggagaccagaagagagagaagaagactgatgagcatggagatggactag

SEQ ID NO: 94821 - DNA, 1161 bp, Artificial Sequence
  Description of Artificial Sequence: Synthetic coding sequence
atggccgacagctgcagaaacctgacctacgtgagaggcagcgtgggccccgccaccagcaccctgatgttcgtggccggcgtggtgggcaacggcctggccctgggcatcctgagcgccagaagacccgccagacccagcgccttcgccgtgctggtgaccggcctggccgccaccgacctgctgggcaccagcttcctgagccccgccgtgttcgtggcctacgccagaaacagcagcctgctgggcctggccagaggcggccccgccctgtgcgacgccttcgccttcgccatgaccttcttcggcctggccagcatgctgatcctgttcgccatggccgtggagagatgcctggccctgagccacccctacctgtacgcccagctggacggccccagatgcgccagactggccctgcccgccatctacgccttctgcgtgctgttctgcgccctgcccctgctgggcctgggccagcaccagcagtactgccccggcagctggtgcttcctgagaatgagatgggcccagcccggcggcgccgccttcagcctggcctacgccggcctggtggccctgctggtggccgccatcttcctgtgcaacggcagcgtgaccctgagcctgtgcagaatgtacagacagcagaagagacaccagggcagcctgggccccagacccagaaccggcgaggacgaggtggaccacctgatcctgctggccctgatgaccgtggtgatggccgtgtgcagcctgcccctgaccatcagatgcttcacccaggccgtggcccccgacagcagcagcgagatgggcgacctgctggccttcagattctacgccttcaaccccatcctggacccctgggtgttcatcctgttcagaaaggccgtgttccagagactgaagctgtgggtgtgctgcctgtgcctgggccccgcccacggcgacagccagacccccctgagccagctggccagcggcagaagagaccccagagcccccagcgcccccgtgggcaaggagggcagctgcgtgcccctgagcgcctggggcgagggccaggtggagcccctgccccccacccagcagagcagcggcagcgccgtgggcaccagcagcaaggccgaggccagcgtggcctgcagcctgtgctag

SEQ ID NO: 94822 - DNA, 1503 bp, Artificial Sequence
  Description of Artificial Sequence: Synthetic coding sequence
atggcctgggccgccctgctgggcctgctggccgccctgctgctgctgctgctgctgagcagaagaagaaccagaagacccggcgagccccccctggacctgggcagcatcccctggctgggctacgccctggacttcggcaaggacgccgccagcttcctgaccagaatgaaggagaagcacggcgacatcttcaccatcctggtgggcggcagatacgtgaccgtgctgctggacccccacagctacgacgccgtggtgtgggagcccagaaccagactggacttccacgcctacgccatcttcctgatggagagaatcttcgacgtgcagctgccccactacagccccagcgacgagaaggccagaatgaagctgaccctgctgcacagagagctgcaggccctgaccgaggccatgtacaccaacctgcacgccgtgctgctgggcgacgccaccgaggccggcagcggctggcacgagatgggcctgctggacttcagctacagcttcctgctgagagccggctacctgaccctgtacggcatcgaggccctgcccagaacccacgagagccaggcccaggacagagtgcacagcgccgacgtgttccacaccttcagacagctggacagactgctgcccaagctggccagaggcagcctgagcgtgggcgacaaggaccacatgtgcagcgtgaagagcagactgtggaagctgctgagccccgccagactggccagaagagcccacagaagcaagtggctggagagctacctgctgcacctggaggagatgggcgtgagcgaggagatgcaggccagagccctggtgctgcagctgtgggccacccagggcaacatgggccccgccgccttctggctgctgctgttcctgctgaagaaccccgaggccctggccgccgtgagaggcgagctggagagcatcctgtggcaggccgagcagcccgtgagccagaccaccaccctgccccagaaggtgctggacagcacccccgtgctggacagcgtgctgagcgagagcctgagactgaccgccgcccccttcatcaccagagaggtggtggtggacctggccatgcccatggccgacggcagagagttcaacctgagaagaggcgacagactgctgctgttccccttcctgagcccccagagagaccccgagatctacaccgaccccgaggtgttcaagtacaacagattcctgaaccccgacggcagcgagaagaaggacttctacaaggacggcaagagactgaagaactacaacatgccctggggcgccggccacaaccactgcctgggcagaagctacgccgtgaacagcatcaagcagttcgtgttcctggtgctggtgcacctggacctggagctgatcaacgccgacgtggagatccccgagttcgacctgagcagatacggcttcggcctgatgcagcccgagcacgacgtgcccgtgagatacagaatcagaccctag

SEQ ID NO: 94823 - DNA, 408 bp, Artificial Sequence
  Description of Artificial Sequence: Synthetic coding sequence
atgagagccttcctgagaaaccagaagtacgaggacatgcacaacatcatccacatcctgcagatcagaaagctgagacacagactgagcaacttccccagactgcccggcatcctggcccccgagaccgtgctgctgcccttctgctacaaggtgttcagaaagaaggagaaggtgaagagaagccagaaggccaccgagttcatcgactacagcatcgagcagagccaccacgccatcctgacccccctgcagacccacctgaccatgaagggcagcagcatgaagtgcagcagcctgagcagcgaggccatcctgttcaccctgaccctgcagctgacccagaccctgggcctggagtgctgcctgctgtacctgagcaagaccatccacccccagatcatctag

SEQ ID NO: 94824 - DNA, 345 bp, Artificial Sequence
  Description of Artificial Sequence: Synthetic coding sequence
atggccggcctggccctgcagcccggcaccgccctgctgtgctacagctgcaaggcccaggtgagcaacgaggactgcctgcaggtggagaactgcacccagctgggcgagcagtgctggaccgccagaatcagagccgtgggcctgctgaccgtgatcagcaagggctgcagcctgaactgcgtggacgacagccaggactactacgtgggcaagaagaacatcacctgctgcgacaccgacctgtgcaacgccagcggcgcccacgccctgcagcccgccgccgccatcctggccctgctgcccgccctgggcctgctgctgtggggccccggccagctgtag

SEQ ID NO: 94825 - DNA, 714 bp, Artificial Sequence
  Description of Artificial Sequence: Synthetic coding sequence
atgatggtgatggtggtggtgatcacctgcctgctgagccactacaagctgagcgccagaagcttcatcagcagacacagccagggcagaagaagagaggacgccctgagcagcgagggctgcctgtggcccagcgagagcaccgtgagcggcaacggcatccccgagccccaggtgtacgccccccccagacccaccgacagactggccgtgccccccttcgcccagagagagagattccacagattccagcccacctacccctacctgcagcacgagatcgacctgccccccaccatcagcctgagcgacggcgaggagccccccccctaccagggcccctgcaccctgcagctgagagaccccgagcagcagctggagctgaacagagagagcgtgagagccccccccaacagaaccatcttcgacagcgacctgatggacagcgccagactgggcggcccctgcccccccagcagcaacagcggcatcagcgccacctgctacggcagcggcggcagaatggagggccccccccccacctacagcgaggtgatcggccactaccccggcagcagcttccagcaccagcagagcagcggcccccccagcctgctggagggcaccagactgcaccacacccacatcgcccccctggagagcgccgccatctggagcaaggagaaggacaagcagaagggccaccccctgtag

SEQ ID NO: 94826 - DNA, 864 bp, Artificial Sequence
  Description of Artificial Sequence: Synthetic coding sequence
atgcacagactgatgggcgtgaacagcaccgccgccgccgccgccggccagcccaacgtgagctgcacctgcaactgcaagagaagcctgttccagagcatggagatcaccgagctggagttcgtgcagatcatcatcatcgtggtggtgatgatggtgatggtggtggtgatcacctgcctgctgagccactacaagctgagcgccagaagcttcatcagcagacacagccagggcagaagaagagaggacgccctgagcagcgagggctgcctgtggcccagcgagagcaccgtgagcggcaacggcatccccgagccccaggtgtacgccccccccagacccaccgacagactggccgtgccccccttcgcccagagagagagattccacagattccagcccacctacccctacctgcagcacgagatcgacctgccccccaccatcagcctgagcgacggcgaggagccccccccctaccagggcccctgcaccctgcagctgagagaccccgagcagcagctggagctgaacagagagagcgtgagagccccccccaacagaaccatcttcgacagcgacctgatggacagcgccagactgggcggcccctgcccccccagcagcaacagcggcatcagcgccacctgctacggcagcggcggcagaatggagggccccccccccacctacagcgaggtgatcggccactaccccggcagcagcttccagcaccagcagagcagcggcccccccagcctgctggagggcaccagactgcaccacacccacatcgcccccctggagagcgccgccatctggagcaaggagaaggacaagcagaagggccaccccctgtag

SEQ ID NO: 94827 - DNA, 759 bp, Artificial Sequence
  Description of Artificial Sequence: Synthetic coding sequence
atggccgagctggagttcgtgcagatcatcatcatcgtggtggtgatgatggtgatggtggtggtgatcacctgcctgctgagccactacaagctgagcgccagaagcttcatcagcagacacagccagggcagaagaagagaggacgccctgagcagcgagggctgcctgtggcccagcgagagcaccgtgagcggcaacggcatccccgagccccaggtgtacgccccccccagacccaccgacagactggccgtgccccccttcgcccagagagagagattccacagattccagcccacctacccctacctgcagcacgagatcgacctgccccccaccatcagcctgagcgacggcgaggagccccccccctaccagggcccctgcaccctgcagctgagagaccccgagcagcagctggagctgaacagagagagcgtgagagccccccccaacagaaccatcttcgacagcgacctgatggacagcgccagactgggcggcccctgcccccccagcagcaacagcggcatcagcgccacctgctacggcagcggcggcagaatggagggccccccccccacctacagcgaggtgatcggccactaccccggcagcagcttccagcaccagcagagcagcggcccccccagcctgctggagggcaccagactgcaccacacccacatcgcccccctggagagcgccgccatctggagcaaggagaaggacaagcagaagggccaccccctgtag

SEQ ID NO: 94828 - DNA, 714 bp, Artificial Sequence; identical to SEQ ID NO: 94825
  Description of Artificial Sequence: Synthetic coding sequence

SEQ ID NO: 94829 - DNA, 714 bp, Artificial Sequence; identical to SEQ ID NO: 94825
  Description of Artificial Sequence: Synthetic coding sequence

SEQ ID NO: 94830 - DNA, 684 bp, Artificial Sequence
  Description of Artificial Sequence: Synthetic coding sequence
atgcacagactgatgggcgtgaacagcaccgccgccgccgccgccggccagcccaacgtgagctgcacctgcaactgcaagagaagcctgttccagagcatggagatcagctgccacggcttccccgtgtgcaagagccaccagcaccaggagtggaagagcctgtgctggagcctgagaagccccggcggcgccagcagcatcaccggcttcggcagcatgaaggtgaccaaccccgccatgaacctgcccgagtgccagtggctgagaatccagaaggccgagctggagttcgtgcagatcatcatcatcgtggtggtgatgatggtgatggtggtggtgatcacctgcctgctgagccactacaagctgagcgccagaagcttcatcagcagacacagccagggcagaagaagagaggacgccctgagcagcgagggctgcctgtggcccagcgagagcaccgtgagcggcaacggcatccccgagccccaggtgtacgccccccccagacccaccgacagactggccgtgccccccttcgcccagagagagagattccacagattccagcccacctacccctacctgcagcacgagatcgacctgccccccaccatcagcctgagcgacggcgaggagccccccccctaccagggcccctgcaccctgcagctgagatag

SEQ ID NO: 94831 - DNA, 627 bp, Artificial Sequence
  Description of Artificial Sequence: Synthetic coding sequence
atgcccgccatccccgcccacggcgccgagctggagttcgtgcagatcatcatcatcgtggtggtgatgatggtgatggtggtggtgatcacctgcctgctgagccactacaagctgagcgccagaagcttcatcagcagacacagccagggcagaagaagagaggacgccctgagcagcgagggctgcctgtggcccagcgagagcaccgtgagcggcaacggcatccccgagccccaggtgtacgccccccccagacccaccgacagactggccgtgccccccttcgcccagagagagagattccacagattccagcccacctacccctacctgcagcacgagatcgacctgccccccaccatcagcctgagcgacggcgaggagccccccccctaccagggcccctgcaccctgcagctgagagaccccgagcagcagctggagctgaacagagagagcgtgagagccccccccaacagaaccatcttcgacagcgacctgatggacagcgccagactgggcggcccctgcccccccagcagcaacagcggcatcagcgccacctgctacggcagcggcggcagaatggagggccccccccccacctacagcgaggtgatctag

SEQ ID NO: 94832 - DNA, 156 bp, Artificial Sequence
  Description of Artificial Sequence: Synthetic coding sequence
atggccagatacagatgctgcagaagccagagcagaagcagatactacagacagagacagagaagcagaagaagaagaagaagaagctgccagaccagaagaagagccatgagatgctgcagacccagatacagacccagatgcagaagacactag

SEQ ID NO: 94833 - DNA, 309 bp, Artificial Sequence
  Description of Artificial Sequence: Synthetic coding sequence
atggtgagatacagagtgagaagcctgagcgagagaagccacgaggtgtacagacagcagctgcacggccaggagcagggccaccacggccaggaggagcagggcctgagccccgagcacgtggaggtgtacgagagaacccacggccagagccactacagaagaagacactgcagcagaagaagactgcacagaatccacagaagacagcacagaagctgcagaagaagaaagagaagaagctgcagacacagaagaagacacagaagaggctgcagaaccagaaagagaacctgcagaagacactag

SEQ ID NO: 94834 - DNA, 423 bp, Artificial Sequence
  Description of Artificial Sequence: Synthetic coding sequence
atggtgagatacagagtgagaagcctgagcgagagaagccacgaggtgtacagacagcagctgcacggccaggagcagggccaccacggccaggaggagcagggcctgagccccgagcacgtggaggtgtacgagagaacccacggccagagccactacagaagaagacactgcagcagaagaagactgcacagaatccacagaagacagcacagaagctgcagaagaagaaagagaagaagctgcagacacagaagaagacacagaagagagagcctgggcgaccccctgaaccagaacttcctgagccagaaggccgccgagcccggcagagagcacgccgagggcaccaagctgcccggccccctgacccccagctggaagctgagaaagagcagacccaagcaccaggtgagaccctag

SEQ ID NO: 94835 - DNA, 657 bp, Artificial Sequence
  Description of Artificial Sequence: Synthetic coding sequence
tgactggccctgctgctggccagagccggcctgagaaagcccgagagccaggaggccgcccccctgagcggcccctgcggcagaagagtgatcaccagcagaatcgtgggcggcgaggacgccgagctgggcagatggccctggcagggcagcctgagactgtgggacagccacgtgtgcggcgtgagcctgctgagccacagatgggccctgaccgccgcccactgcttcgagaccgacctgagcgaccccagcggctggatggtgcagttcggccagctgaccagcatgcccagcttctggagcctgcaggcctactacaccagatacttcgtgagcaacatctacctgagccccagatacctgggcaacagcccctacgacatcgccctggtgaagctgagcgcccccgtgacctacaccaagcacatccagcccatctgcctgcaggccagcaccttcgagttcgagaacagaaccgactgctgggtgaccggctggggctacatcaaggaggacgagggcagcagcggcagacaccacaagcagctgtacgtgcagccccccctgccccaggtgcagttcccccagggccacctgtggagacacggcctgtgctggcagtgccccagaagagagggctgcctgctgagatag

SEQ ID NO: 94836 - DNA, 744 bp, Artificial Sequence
  Description of Artificial Sequence: Synthetic coding sequence
atgaaccccctgctgatcctgaccttcgtggccgccgccctggccgcccccttcgacgacgacgacaagatcgtgggcggctacaactgcgaggagaacagcgtgccctaccaggtgagcctgaacagcggctaccacttctgcggcggcagcctgatcaacgagcagtgggtggtgagcgccggccactgctacaagagcagaatccaggtgagactgggcgagcacaacatcgaggtgctggagggcaacgagcagttcatcaacgccgccaagatcatcagacacccccagtacgacagaaagaccctgaacaacgacatcatgctgatcaagctgagcagcagagccgtgatcaacgccagagtgagcaccatcagcctgcccaccgccccccccgccaccggcaccaagtgcctgatcagcggctggggcaacaccgccagcagcggcgccgactaccccgacgagctgcagtgcctggacgcccccgtgctgagccaggccaagtgcgaggccagctaccccggcaagatcaccagcaacatgttctgcgtgggcttcctggagggcggcaaggacagctgccagggcgacagcggcggccccgtggtgtgcaacggccagctgcagggcgtggtgagctggggcgacggctgcgcccagaagaacaagcccggcgtgtacaccaaggtgtacaactacgtgaagtggatcaagaacaccatcgccgccaacagctag

SEQ ID NO: 94837 - DNA, 714 bp, Artificial Sequence
  Description of Artificial Sequence: Synthetic coding sequence
atgaaccccctgctgatcctgaccttcgtggccgccgccctggccgcccccttcgacgacgacgacaagatcgtgggcggctacaactgcgaggagaacagcgtgccctaccaggtgagcctgaacagcggctaccacttctgcggcggcagcctgatcaacgagcagtgggtggtgagcgccggccactgctacaagagcagaatccaggtgagactgggcgagcacaacatcaacgccgccaagatcatcagacacccccagtacgacagaaagaccctgaacaacgacatcatgctgatcaagctgagcagcagagccgtgatcaacgccagagtgagcaccatcagcctgcccaccgccccccccgccaccggcaccaagtgcctgatcagcggctggggcaacaccgccagcagcggcgccgactaccccgacgagctgcagtgcctggacgcccccgtgctgagccaggccaagtgcgaggccagctaccccggcaagatcaccagcaacatgttctgcgtgggcttcctggagggcggcaaggacagctgccagggcgacagcggcggccccgtggtgtgcaacggccagctgcagggcgtggtgagctggggcgacggctgcgcccagaagaacaagcccggcgtgtacaccaaggtgtacaactacgtgaagtggatcaagaacaccatcgccgccaacagctag

SEQ ID NO: 94838 - DNA, 2628 bp, Artificial Sequence
  Description of Artificial Sequence: Synthetic coding sequence
atgaccctggccagattcgtgctggccctgatgctgggcgccctgcccgaggtggtgggcttcgacagcgtgctgaacgacagcctgcaccacagccacagacacagcccccccgccggcccccactacccctactacctgcccacccagcagagaccccccagaaccagaccccccccccccctgcccagattccccagaccccccagagccctgcccgcccagagaccccacgccctgcaggccggccacacccccagaccccacccctggggctgccccgccggcgagccctgggtgagcgtgaccgacttcggcgccccctgcctgagatgggccgaggtgccccccttcctggagagaagcccccccgccagctgggcccagctgagaggccagagacacaacttctgcagaagccccgacggcgccggcagaccctggtgcttctacggcgacgccagaggcaaggtggactggggctactgcgactgcagacacggcagcgtgagactgagaggcggcaagaacgagttcgagggcaccgtggaggtgtacgccagcggcgtgtggggcaccgtgtgcagcagccactgggacgacagcgacgccagcgtgatctgccaccagctgcagctgggcggcaagggcatcgccaagcagacccccttcagcggcctgggcctgatccccatctactggagcaacgtgagatgcagaggcgacgaggagaacatcctgctgtgcgagaaggacatctggcagggcggcgtgtgcccccagaagatggccgccgccgtgacctgcagcttcagccacggccccaccttccccatcatcagactggccggcggcagcagcgtgcacgagggcagagtggagctgtaccacgccggccagtggggcaccgtgtgcgacgaccagtgggacgacgccgacgccgaggtgatctgcagacagctgggcctgagcggcatcgccaaggcctggcaccaggcctacttcggcgagggcagcggccccgtgatgctggacgaggtgagatgcaccggcaacgagctgagcatcgagcagtgccccaagagcagctggggcgagcacaactgcggccacaaggaggacgccggcgtgagctgcacccccctgaccgacggcgtgatcagactggccggcggcaagggcagccacgagggcagactggaggtgtactacagaggccagtggggcaccgtgtgcgacgacggctggaccgagctgaacacctacgtggtgtgcagacagctgggcttcaagtacggcaagcaggccagcgccaaccacttcgaggagagcaccggccccatctggctggacgacgtgagctgcagcggcaaggagaccagattcctgcagtgcagcagaagacagtggggcagacacgactgcagccacagagaggacgtgagcatcgcctgctaccccggcggcgagggccacagactgagcctgggcttccccgtgagactgatggacggcgagaacaagaaggagggcagagtggaggtgttcatcaacggccagtggggcaccatctgcgacgacggctggaccgacaaggacgccgccgtgatctgcagacagctgggctacaagggccccgccagagccagaaccatggcctacttcggcgagggcaagggccccatccacgtggacaacgtgaagtgcaccggcaacgagagaagcctggccgactgcatcaagcaggacatcggcagacacaactgcagacacagcgaggacgccggcgtgatctgcgactacttcggcaagaaggccagcggcaacagcaacaaggagagcctgagcagcgtgtgcggcctgagactgctgcacagaagacagaagagaatcatcggcggcaagaacagcctgagaggcggctggccctggcaggtgagcctgagactgaagagcagccacggcgacggcagactgctgtgcggcgccaccctgctgagcagctgctgggtgctgaccgccgcccactgcttcaagagatacggcaacagcaccagaagctacgccgtgagagtgggcgactaccacaccctggtgcccgaggagttcgaggaggagatcggcgtgcagcagatcgtgatccacagagagtacagacccgacagaagcgactacgacatcgccctggtgagactgcagggccccgaggagcagtgcgccagattcagcagccacgtgctgcccgcctgcctgcccctgtggagagagagaccccagaagaccgccagcaactgctacatcaccggctggggcgacaccggcagagcctacagcagaaccctgcagcaggccgccatccccctgctgcccaagagattctgcgaggagagatacaagggcagattcaccggcagaatgctgtgcgccggcaacctgcacgagcacaagagagtggacagctgccagggcgacagcggcggccccctgatgtgcgagagacccggcgagagctgggtggtgtacggcgtgaccagctggggctacggctgcggcgtgaaggacagccccggcgtgtacaccaaggtgagcgccttcgtgccctggatcaagagcgtgaccaagctgtag

SEQ ID NO: 94839 - DNA, 489 bp, Artificial Sequence
  Description of Artificial Sequence: Synthetic coding sequence
atgaagggcttcaccgccaccctgttcctgtggaccctgatcttccccagctgcagcggcggcggcggcggcaaggcctggcccacccacgtggtgtgcagcgacagcggcctggaggtgctgtaccagagctgcgaccccctgcaggacttcggcttcagcgtggagaagtgcagcaagcagctgaagagcaacatcaacatcagattcggcatcatcctgagagaggacatcaaggagctgttcctggacctggccctgatgagccagggcagcagcgtgctgaacttcagctaccccatctgcgaggccgccctgcccaagttcagcttctgcggcagaagaaagggcgagcagatctactacgccggccccgtgaacaaccccgagttcaccatcccccagggcgagtaccaggtgctgctggagctgtacaccgagaagagaagcaccgtggcctgcgccaacgccaccatcatgtgcagctag

SEQ ID NO: 94840 - DNA, 822 bp, Artificial Sequence
  Description of Artificial Sequence: Synthetic coding sequence
atggccgtgtggctggcccagtggctgggccccctgctgctggtgagcctgtggggcctgctggcccccgccagcctgctgagaagactgggcgagcacatccagcagttccaggagagcagcgcccagggcctgggcctgagcctgggccccggcgccgccgccctgcccaaggtgggctggctggagcagctgctggaccccttcaacgtgagcgacagaagaagcttcctgcagagatactgggtgaacgaccagcactgggtgggccaggacggccccatcttcctgcacctgggcggcgagggcagcctgggccccggcagcgtgatgagaggccaccccgccgccctggcccccgcctggggcgccctggtgatcagcctggagcacagattctacggcctgagcatccccgccggcggcctggagatggcccagctgagattcctgagcagcagactggccctggccgacgtggtgagcgccagactggccctgagcagactgttcaacatcagcagcagcagcccctggatctgcttcggcggcagctacgccggcagcctggccgcctgggccagactgaagttcccccacctgatcttcgccagcgtggccagcagcgcccccgtgagagccgtgctggacttcagcgagtacaacgacatcgtgctgcacagcctgggccagaagtgcctgagcttcagcagagccgagaccgtggcccagctgagaagcaccgagccccagctgagcggcgtgggcgacagacagtggctgtaccagacctgcaccgagttcggcttctacatcacctag

SEQ ID NO: 94841 - DNA, 501 bp, Artificial Sequence
  Description of Artificial Sequence: Synthetic coding sequence
atggccgtgtggctggcccagtggctgggccccctgctgctggtgagcctgtggggcctgctggcccccgccagcctgctgagaagactgggcgagcacatccagcagttccaggagagcagcgcccagggcctgggcctgagcctgggccccggcgccgccgccctgcccaaggtgggctggctggagcagctgctggaccccttcaacgtgagcgacagaagaagcttcctgcagagatactgggtgaacgaccagcactgggtgggccaggacggccccatcttcctgcacctgggcggcgagggcagcctgggccccggcagcgtgatgagaggccaccccgccgccctggcccccgcctggggcgccctggtgatcagcctggagcacagattctacggcctgagcatccccgccggcggcctggagatggcccagctgagattcctgagcagcagactggccctgagctgcaccgcctgggccagaagcgtgtag

SEQ ID NO: 94842 - DNA, 498 bp, Artificial Sequence
  Description of Artificial Sequence: Synthetic coding sequence
tgagtgatgagaggccaccccgccgccctggcccccgcctggggcgccctggtgatcagcctggagcacagattctacggcctgagcatccccgccggcggcctggagatggcccagctgagattcctgagcagcagactggccctggccgacgtggtgagcgccagactggccctgagcagactgttcaacatcagcagcagcagcccctggatctgcttcggcggcagctacgccggcagcctggccgcctgggccagactgaagttcccccacctgatcttcgccagcgtggccagcagcgcccccgtgagagccgtgctggacttcagcgagtacaacgacatcgtgctgcacagcctgggccagaagtgcctgagcttcagcagagccgagaccgtggcccagctgagaagcaccgagccccagctgagcggcgtgggcgacagacagtggctgtaccagacctgcaccgagttcggcttctacgtgacctag

SEQ ID NO: 94843 - DNA, 945 bp, Artificial Sequence
  Description of Artificial Sequence: Synthetic coding sequence
atgggcgccagaggcgccctgctgctggccctgctgctggccagagccggcctgagaaagcccgagagccaggaggccgcccccctgagcggcccctgcggcagaagagtgatcaccagcagaatcgtgggcggcgaggacgccgagctgggcagatggccctggcagggcagcctgagactgtgggacagccacgtgtgcggcgtgagcctgctgagccacagatgggccctgaccgccgcccactgcttcgagacctacagcgacctgagcgaccccagcggctggatggtgcagttcggccagctgaccagcatgcccagcttctggagcctgcaggcctactacaccagatacttcgtgagcaacatctacctgagccccagatacctgggcaacagcccctacgacatcgccctggtgaagctgagcgcccccgtgacctacaccaagcacatccagcccatctgcctgcaggccagcaccttcgagttcgagaacagaaccgactgctgggtgaccggctggggctacatcaaggaggacgaggccctgcccagcccccacaccctgcaggaggtgcaggtggccatcatcaacaacagcatgtgcaaccacctgttcctgaagtacagcttcagaaaggacatcttcggcgacatggtgtgcgccggcaacgcccagggcggcaaggacgcctgcttcggcgacagcggcggccccctggcctgcaacaagaacggcctgtggtaccagatcggcgtggtgagctggggcgtgggctgcggcagacccaacagacccggcgtgtacaccaacatcagccaccacttcgagtggatccagaagctgatggcccagagcggcatgagccagcccgaccccagctggcccctgctgttcttccccctgctgtgggccctgcccctgctgggccccgtgtag

SEQ ID NO: 94844 - DNA, 903 bp, Artificial Sequence
  Description of Artificial Sequence: Synthetic coding sequence
atgggcgccagaggcgccctgctgctggccctgctgctggccagagccggcctgagaaagcccgagagccaggaggccgcccccctgagcggcccctgcggcagaagagtgatcaccagcagaatcgtgggcggcgaggacgccgagctgggcagatggccctggcagggcagcctgagactgtgggacagccacgtgtgcggcgtgagcctgctgagccacagatgggccctgaccgccgcccactgcttcgagacctacagcgacctgagcgaccccagcggctggatggtgcagttcggccagctgaccagcatgcccagcttctggagcctgcaggcctactacaccagatacttcgtgagcaacatctacctgagccccagatacctgggcaacagcccctacgacatcgccctggtgaagctgagcgcccccgtgacctacaccaagcacatccagcccatctgcctgcaggccagcaccttcgagttcgagaacagaaccgactgctgggtgaccggctggggctacatcaaggaggacgaggccctgcccagcccccacaccctgcaggaggtgcaggtggccatcatcaacaacagcatgtgcaaccacctgttcctgaagtacagcttcagaaaggacatcttcggcgacatgggcgacagcggcggccccctggcctgcaacaagaacggcctgtggtaccagatcggcgtggtgagctggggcgtgggctgcggcagacccaacagacccggcgtgtacaccaacatcagccaccacttcgagtggatccagaagctgatggcccagagcggcatgagccagcccgaccccagctggcccctgctgttcttccccctgctgtgggccctgcccctgctgggccccgtgtag

SEQ ID NO: 94845 - DNA, 939 bp, Artificial Sequence
  Description of Artificial Sequence: Synthetic coding sequence
atgggcgccagaggcgccctgctgctggccctgctgctggccagagccggcctgagaaagcccgagagccaggaggccgcccccctgagcggcccctgcggcagaagagtgatcaccagcagaatcgtgggcggcgaggacgccgagctgggcagatggccctggcagggcagcctgagactgtgggacagccacgtgtgcggcgtgagcctgctgagccacagatgggccctgaccgccgcccactgcttcgagaccgacctgagcgaccccagcggctggatggtgcagttcggccagctgaccagcatgcccagcttctggagcctgcaggcctactacaccagatacttcgtgagcaacatctacctgagccccagatacctgggcaacagcccctacgacatcgccctggtgaagctgagcgcccccgtgacctacaccaagcacatccagcccatctgcctgcaggccagcaccttcgagttcgagaacagaaccgactgctgggtgaccggctggggctacatcaaggaggacgaggccctgcccagcccccacaccctgcaggaggtgcaggtggccatcatcaacaacagcatgtgcaaccacctgttcctgaagtacagcttcagaaaggacatcttcggcgacatggtgtgcgccggcaacgcccagggcggcaaggacgcctgcttcggcgacagcggcggccccctggcctgcaacaagaacggcctgtggtaccagatcggcgtggtgagctggggcgtgggctgcggcagacccaacagacccggcgtgtacaccaacatcagccaccacttcgagtggatccagaagctgatggcccagagcggcatgagccagcccgaccccagctggcccctgctgttcttccccctgctgtgggccctgcccctgctgggccccgtgtag

SEQ ID NO: 94846 - DNA, 954 bp, Artificial Sequence
  Description of Artificial Sequence: Synthetic coding sequence
atggtggtgagcggcgccccccccgccctgggcggcggctgcctgggcaccttcaccagcctgctgctgctggccagcaccgccatcctgaacgccgccagaatccccgtgccccccgcctgcggcaagccccagcagctgaacagagtggtgggcggcgaggacagcaccgacagcgagtggccctggatcgtgagcatccagaagaacggcacccaccactgcgccggcagcctgctgaccagcagatgggtgatcaccgccgcccactgcttcaaggacaacctgaacaagccctacctgttcagcgtgctgctgggcgcctggcagctgggcaaccccggcagcagaagccagaaggtgggcgtggcctgggtggagccccaccccgtgtacagctggaaggagggcgcctgcgccgacatcgccctggtgagactggagagaagcatccagttcagcgagagagtgctgcccatctgcctgcccgacgccagcatccacctgccccccaacacccactgctggatcagcggctggggcagcatccaggacggcgtgcccctgccccacccccagaccctgcagaagctgaaggtgcccatcatcgacagcgaggtgtgcagccacctgtactggagaggcgccggccagggccccatcaccgaggacatgctgtgcgccggctacctggagggcgagagagacgcctgcctgggcgacagcggcggccccctgatgtgccaggtggacggcgcctggctgctggccggcatcatcagctggggcgagggctgcgccgagagaaacagacccggcgtgtacatcagcctgagcgcccacagaagctgggtggagaagatcgtgcagggcgtgcagctgagaggcagagcccagggcggcggcgccctgagagcccccagccagggcagcggcgccgccgccagaagctag

SEQ ID NO: 94847 - DNA, 786 bp, Artificial Sequence
  Description of Artificial Sequence: Synthetic coding sequence
atgcacatgagagagaccagcggcttcaccctgaagaagggcagaagcgcccccctggtgttccacccccccgacgccctgatcgccgtgcccttcgacgacgacgacaagatcgtgggcggctacacctgcgaggagaacagcctgccctaccaggtgagcctgaacagcggcagccacttctgcggcggcagcctgatcagcgagcagtgggtggtgagcgccgcccactgctacaagaccagaatccaggtgagactgggcgagcacaacatcaaggtgctggagggcaacgagcagttcatcaacgccgccaagatcatcagacaccccaagtacaacagagacaccctggacaacgacatcatgctgatcaagctgagcagccccgccgtgatcaacgccagagtgagcaccatcagcctgcccaccaccccccccgccgccggcaccgagtgcctgatcagcggctggggcaacaccctgagcttcggcgccgactaccccgacgagctgaagtgcctggacgcccccgtgctgacccaggccgagtgcaaggccagctaccccggcaagatcaccaacagcatgttctgcgtgggcttcctggagggcggcaaggacagctgccagagagacagcggcggccccgtggtgtgcaacggccagctgcagggcgtggtgagctggggccacggctgcgcctggaagaacagacccggcgtgtacaccaaggtgtacaactacgtggactggatcaaggacaccatcgccgccaacagctag

SEQ ID NO: 94848 - DNA, 915 bp, Artificial Sequence
  Description of Artificial Sequence: Synthetic coding sequence
atgtgcggccccgacgacagatgccccgccagatggcccggccccggcagagccgtgaagtgcggcaagggcctggccgccgccagacccggcagagtggagagaggcggcgcccagagaggcggcgccggcctggagctgcaccccctgctgggcggcagaacctggagagccgccagagacgccgacggctgcgaggccctgggcaccgtggccgtgcccttcgacgacgacgacaagatcgtgggcggctacacctgcgaggagaacagcctgccctaccaggtgagcctgaacagcggcagccacttctgcggcggcagcctgatcagcgagcagtgggtggtgagcgccgcccactgctacaagaccagaatccaggtgagactgggcgagcacaacatcaaggtgctggagggcaacgagcagttcatcaacgccgccaagatcatcagacaccccaagtacaacagagacaccctggacaacgacatcatgctgatcaagctgagcagccccgccgtgatcaacgccagagtgagcaccatcagcctgcccaccaccccccccgccgccggcaccgagtgcctgatcagcggctggggcaacaccctgagcttcggcgccgactaccccgacgagctgaagtgcctggacgcccccgtgctgacccaggccgagtgcaaggccagctaccccggcaagatcaccaacagcatgttctgcgtgggcttcctggagggcggcaaggacagctgccagagagacagcggcggccccgtggtgtgcaacggccagctgcagggcgtggtgagctggggccacggctgcgcctggaagaacagacccggcgtgtacaccaaggtgtacaactacgtggactggatcaaggacaccatcgccgccaacagctag

SEQ ID NO: 94849 - DNA, 744 bp, Artificial Sequence
  Description of Artificial Sequence: Synthetic coding sequence
atgaaccccttcctgatcctggccttcgtgggcgccgccgtggccgtgcccttcgacgacgacgacaagatcgtgggcggctacacctgcgaggagaacagcctgccctaccaggtgagcctgaacagcggcagccacttctgcggcggcagcctgatcagcgagcagtgggtggtgagcgccgcccactgctacaagaccagaatccaggtgagactgggcgagcacaacatcaaggtgctggagggcaacgagcagttcatcaacgccgccaagatcatcagacaccccaagtacaacagagacaccctggacaacgacatcatgctgatcaagctgagcagccccgccgtgatcaacgccagagtgagcaccatcagcctgcccaccaccccccccgccgccggcaccgagtgcctgatcagcggctggggcaacaccctgagcttcggcgccgactaccccgacgagctgaagtgcctggacgcccccgtgctgacccaggccgagtgcaaggccagctaccccggcaagatcaccaacagcatgttctgcgtgggcttcctggagggcggcaaggacagctgccagagagacagcggcggccccgtggtgtgcaacggccagctgcagggcgtggtgagctggggccacggctgcgcctggaagaacagacccggcgtgtacaccaaggtgtacaactacgtggactggatcaaggacaccatcgccgccaacagctag

SEQ ID NO: 94850 - DNA, 723 bp, Artificial Sequence
  Description of Artificial Sequence: Synthetic coding sequence
atgggccccgccggcgaggtggccgtgcccttcgacgacgacgacaagatcgtgggcggctacacctgcgaggagaacagcctgccctaccaggtgagcctgaacagcggcagccacttctgcggcggcagcctgatcagcgagcagtgggtggtgagcgccgcccactgctacaagaccagaatccaggtgagactgggcgagcacaacatcaaggtgctggagggcaacgagcagttcatcaacgccgccaagatcatcagacaccccaagtacaacagagacaccctggacaacgacatcatgctgatcaagctgagcagccccgccgtgatcaacgccagagtgagcaccatcagcctgcccaccaccccccccgccgccggcaccgagtgcctgatcagcggctggggcaacaccctgagcttcggcgccgactaccccgacgagctgaagtgcctggacgcccccgtgctgacccaggccgagtgcaaggccagctaccccggcaagatcaccaacagcatgttctgcgtgggcttcctggagggcggcaaggacagctgccagagagacagcggcggccccgtggtgtgcaacggccagctgcagggcgtggtgagctggggccacggctgcgcctggaagaacagacccggcgtgtacaccaaggtgtacaactacgtggactggatcaaggacaccatcgccgccaacagctag

SEQ ID NO: 94851 - DNA, 537 bp, Artificial Sequence
  Description of Artificial Sequence: Synthetic coding sequence
atgagagagaccagcggcttcaccctgaagaagggcagaagcgcccccctggtgttccacccccccgacgccctgatcgccgtgcccttcgacgacgacgacaagatcgtgggcggctacacctgcgaggagaacagcctgccctaccaggtgagcctgaacagcggcagccacttctgcggcggcagcctgatcagcgagcagtgggtggtgagcgccgcccactgctacaagaccagaatccaggtgagactgggcgagcacaacatcaaggtgctggagggcaacgagcagttcatcaacgccgccaagatcatcagacaccccaagtacaacagagacaccctggacaacgacatcatgctgatcaagctgagcagccccgccgtgatcaacgccagagtgagcaccatcagcctgcccaccaccccccccgccgccggcaccgagtgcctgatcagcggctggggcaacaccctgagcttcggcgccgactaccccgacgagctgaagtgcctggacgcccccgtgctgtag

SEQ ID NO: 94852 - DNA, 843 bp, Artificial Sequence
  Description of Artificial Sequence: Synthetic coding sequence
atgagaggcgtgagctgcctgcaggtgctgctgctgctggtgctgggcgccgccggcacccagggcagaaagagcgccgcctgcggccagcccagaatgagcagcagaatcgtgggcggcagagacggcagagacggcgagtggccctggcaggccagcatccagcacagaggcgcccacgtgtgcggcggcagcctgatcgccccccagtgggtgctgaccgccgcccactgcttccccagaagagccctgcccgccgagtacagagtgagactgggcgccctgagactgggcagcaccagccccagaaccctgagcgtgcccgtgagaagagtgctgctgccccccgactacagcgaggacggcgccagaggcgacctggccctgctgcagctgagaagacccgtgcccctgagcgccagagtgcagcccgtgtgcctgcccgtgcccggcgccagacccccccccggcaccccctgcagagtgaccggctggggcagcctgagacccggcgtgcccctgcccgagtggagacccctgcagggcgtgagagtgcccctgctggacagcagaacctgcgacggcctgtaccacgtgggcgccgacgtgccccaggccgagagaatcgtgctgcccggcagcctgtgcgccggctacccccagggccacaaggacgcctgccagggcgacagcggcggccccctgacctgcctgcagagcggcagctgggtgctggtgggcgtggtgagctggggcaagggctgcgccctgcccaacagacccggcgtgtacaccagcgtggccacctacagcccctggatccaggccagagtgagcttctag

SEQ ID NO: 94853 - DNA, 1032 bp, Artificial Sequence
  Description of Artificial Sequence: Synthetic coding sequence
atggcccagaagggcgtgctgggccccggccagctgggcgccgtggccatcctgctgtacctgggcctgctgagaagcggcaccggcgccgagggcgccgaggccccctgcggcgtggccccccaggccagaatcaccggcggcagcagcgccgtggccggccagtggccctggcaggtgagcatcacctacgagggcgtgcacgtgtgcggcggcagcctggtgagcgagcagtgggtgctgagcgccgcccactgcttccccagcgagcaccacaaggaggcctacgaggtgaagctgggcgcccaccagctggacagctacagcgaggacgccaaggtgagcaccctgaaggacatcatcccccaccccagctacctgcaggagggcagccagggcgacatcgccctgctgcagctgagcagacccatcaccttcagcagatacatcagacccatctgcctgcccgccgccaacgccagcttccccaacggcctgcactgcaccgtgaccggctggggccacgtggcccccagcgtgagcctgctgacccccaagcccctgcagcagctggaggtgcccctgatcagcagagagacctgcaactgcctgtacaacatcgacgccaagcccgaggagccccacttcgtgcaggaggacatggtgtgcgccggctacgtggagggcggcaaggacgcctgccagggcgacagcggcggccccctgagctgccccgtggagggcctgtggtacctgaccggcatcgtgagctggggcgacgcctgcggcgccagaaacagacccggcgtgtacaccctggccagcagctacgccagctggatccagagcaaggtgaccgagctgcagcccagagtggtgccccagacccaggagagccagcccgacagcaacctgtgcggcagccacctggccttcagcagcgcccccgcccagggcctgctgagacccatcctgttcctgcccctgggcctggccctgggcctgctgagcccctggctgagcgagcactag

SEQ ID NO: 94854 - DNA, 504 bp, Artificial Sequence
  Description of Artificial Sequence: Synthetic coding sequence
atggcccagaagggcgtgctgggccccggccagctgggcgccgtggccatcctgctgtacctgggcctgctgagaagcggcaccggcaaggagggcgccgccgccccctgcggcgtggccccccaggccagaatcaccggcggcagcagcgccgtggccggccagtggccctggcaggtgagcatcaccttcagcagatacatcagacccatctgcctgcccgccgccaacgccagcttccccaacggcctgcactgcaccgtgaccggctggggccacgtggcccccagcgtgagcctgctgacccccaagcccctgcagcagctggaggtgcccctgatcagcagagagacctgcaactgcctgtacaacatcgacgccaagcccgaggagccccacttcgtgcaggaggacatggtgtgcgccggctacgtggagggcgccctgctgagagtgaccctgggcgcccacagccccgccctgtggagagtgagcggcacctag

SEQ ID NO: 94855 - DNA, 1197 bp, Artificial Sequence
  Description of Artificial Sequence: Synthetic coding sequence
atggagctggaggagggcaaggccggcagcggcctgagacagtactacctgagcaagatcgaggagctgcagctgatcgtgaacgacaagagccagaacctgagaagactgcaggcccagagaaacgagctgaacgccaaggtgagactgctgagagaggagctgcagctgctgcaggagcagggcagctacgtgggcgaggtggtgagagccatggacaagaagaaggtgctggtgaaggtgcaccccgagggcaagttcgtggtggacgtggacaagaacatcgacatcaacgacgtgacccccaactgcagagtggccctgagaaacgacagctacaccctgcacaagatcctgcccaacaaggtggaccccctggtgagcctgatgatggtggagaaggtgcccgacagcacctacgagatgatcggcggcctggacaagcagatcaaggagatcaaggaggtgatcgagctgcccgtgaagcaccccgagctgttcgaggccctgggcatcgcccagcccaagggcgtgctgctgtacggcccccccggcaccggcaagaccctgctggccagagccgtggcccaccacaccgactgcaccttcatcagagtgagcggcagcgagctggtgcagaagttcatcggcgagggcgccagaatggtgagagagctgttcgtgatggccagagagcacgcccccagcatcatcttcatggacgagatcgacagcatcggcagcagcagactggagggcggcagcggcggcgacagcgaggtgcagagaaccatgctggagctgctgaaccagctggacggcttcgaggccaccaagaacatcaaggtgatcatggccaccaacagaatcgacatcctggacagcgccctgctgagacccggcagaatcgacagaaagatcgagttccccccccccaacgaggaggccagactggacatcctgaagatccacagcagaaagatgaacctgaccagaggcatcaacctgagaaagatcgccgagctgatgcccggcgccagcggcgccgaggtgaagggcgtgtgcaccgaggccggcatgtacgccctgagagagagaagagtgcacgtgacccaggaggacttcgagatggccgtggccaaggtgatgcagaaggacagcgagaagaacatgagcatcaagaagctgtggaagtag

SEQ ID NO: 94856 - DNA, 765 bp, Artificial Sequence
  Description of Artificial Sequence: Synthetic coding sequence
atggccagcctgctgaaggtggaccaggaggtgaagctgaaggtggacagcttcagagagagaatcaccagcgaggccgaggacctggtggccaacttcttccccaagaagctgctggagctggacagcttcctgaaggagcccatcctgaacatccacgacctgacccagatccacagcgacatgaacctgcccgtgcccgaccccatcctgctgaccaacagccacgacggcctggacggccccacctacaagaagagaagactggacgagtgcgaggaggccttccagggcaccaaggtgttcgtgatgcccaacggcatgctgaagagcaaccagcagctggtggacatcatcgagaaggtgaagcccgagatcagactgctgatcgagaagtgcaacaccgtgaagatgtgggtgcagctgctgatccccagaatcgaggacggcaacaacttcggcgtgagcatccaggaggagaccgtggccgagctgagaaccgtggagagcgaggccgccagctacctggaccagatcagcagatactacatcaccagagccaagctggtgagcaagatcgccaagtacccccacgtggaggactacagaagaaccgtgaccgagatcgacgagaaggagtacatcagcctgagactgatcatcagcgagctgagaaaccagtacgtgaccctgcacgacatgatcctgaagaacatcgagaagatcaagagacccagaagcagcaacgccgagaccctgtactag

SEQ ID NO: 94857 - DNA, 1323 bp, Artificial Sequence
  Description of Artificial Sequence: Synthetic coding sequence
atgggccagagccagagcggcggccacggccccggcggcggcaagaaggacgacaaggacaagaagaagaagtacgagccccccgtgcccaccagagtgggcaagaagaagaagaagaccaagggccccgacgccgccagcaagctgcccctggtgaccccccacacccagtgcagactgaagctgctgaagctggagagaatcaaggactacctgctgatggaggaggagttcatcagaaaccaggagcagatgaagcccctggaggagaagcaggaggaggagagaagcaaggtggacgacctgagaggcacccccatgagcgtgggcaccctggaggagatcatcgacgacaaccacgccatcgtgagcaccagcgtgggcagcgagcactacgtgagcatcctgagcttcgtggacaaggacctgctggagcccggctgcagcgtgctgctgaaccacaaggtgcacgccgtgatcggcgtgctgatggacgacaccgaccccctggtgaccgtgatgaaggtggagaaggccccccaggagacctacgccgacatcggcggcctggacaaccagatccaggagatcaaggagagcgtggagctgcccctgacccaccccgagtactacgaggagatgggcatcaagccccccaagggcgtgatcctgtacggcccccccggcaccggcaagaccctgctggccaaggccgtggccaaccagaccagcgccaccttcctgagagtggtgggcagcgagctgatccagaagtacctgggcgacggccccaagctggtgagagagctgttcagagtggccgaggagcacgcccccagcatcgtgttcatcgacgagatcgacgccatcggcaccaagagatacgacagcaacagcggcggcgagagagagatccagagaaccatgctggagctgctgaaccagctggacggcttcgacagcagaggcgacgtgaaggtgatcatggccaccaacagaatcgagaccctggaccccgccctgatcagacccggcagaatcgacagaaagatcgagttccccctgcccgacgagaagaccaagaagagaatcttccagatccacaccagcagaatgaccctggccgacgacgtgaccctggacgacctgatcatggccaaggacgacctgagcggcgccgacatcaaggccatctgcaccgaggccggcctgatggccctgagagagagaagaatgaaggtgaccaacgaggacttcaagaagagcaaggagaacgtgctgtacaagaagcaggagggcacccccgagggcctgtacctgtag

SEQ ID NO: 94858 - DNA, 1104 bp, Artificial Sequence
  Description of Artificial Sequence: Synthetic coding sequence
atggaggaggagttcatcagaaaccaggagcagatgaagcccctggaggagaagcaggaggaggagagaagcaaggtggacgacctgagaggcacccccatgagcgtgggcaccctggaggagatcatcgacgacaaccacgccatcgtgagcaccagcgtgggcagcgagcactacgtgagcatcctgagcttcgtggacaaggacctgctggagcccggctgcagcgtgctgctgaaccacaaggtgcacgccgtgatcggcgtgctgatggacgacaccgaccccctggtgaccgtgatgaaggtggagaaggccccccaggagacctacgccgacatcggcggcctggacaaccagatccaggagatcaaggagagcgtggagctgcccctgacccaccccgagtactacgaggagatgggcatcaagccccccaagggcgtgatcctgtacggcccccccggcaccggcaagaccctgctggccaaggccgtggccaaccagaccagcgccaccttcctgagagtggtgggcagcgagctgatccagaagtacctgggcgacggccccaagctggtgagagagctgttcagagtggccgaggagcacgcccccagcatcgtgttcatcgacgagatcgacgccatcggcaccaagagatacgacagcaacagcggcggcgagagagagatccagagaaccatgctggagctgctgaaccagctggacggcttcgacagcagaggcgacgtgaaggtgatcatggccaccaacagaatcgagaccctggaccccgccctgatcagacccggcagaatcgacagaaagatcgagttccccctgcccgacgagaagaccaagaagagaatcttccagatccacaccagcagaatgaccctggccgacgacgtgaccctggacgacctgatcatggccaaggacgacctgagcggcgccgacatcaaggccatctgcaccgaggccggcctgatggccctgagagagagaagaatgaaggtgaccaacgaggacttcaagaagagcaaggagaacgtgctgtacaagaagcaggagggcacccccgagggcctgtacctgtag

SEQ ID NO: 94859 - DNA, 1302 bp, Artificial Sequence
  Description of Artificial Sequence: Synthetic coding sequence
atgcccgactacctgggcgccgaccagagaaagaccaaggaggacgagaaggacgacaagcccatcagagccctggacgagggcgacatcgccctgctgaagacctacggccagagcacctacagcagacagatcaagcaggtggaggacgacatccagcagctgctgaagaagatcaacgagctgaccggcatcaaggagagcgacaccggcctggccccccccgccctgtgggacctggccgccgacaagcagaccctgcagagcgagcagcccctgcaggtggccagatgcaccaagatcatcaacgccgacagcgaggaccccaagtacatcatcaacgtgaagcagttcgccaagttcgtggtggacctgagcgaccaggtggcccccaccgacatcgaggagggcatgagagtgggcgtggacagaaacaagtaccagatccacatccccctgccccccaagatcgaccccaccgtgaccatgatgcaggtggaggagaagcccgacgtgacctacagcgacgtgggcggctgcaaggagcagatcgagaagctgagagaggtggtggagacccccctgctgcaccccgagagattcgtgaacctgggcatcgagccccccaagggcgtgctgctgttcggcccccccggcaccggcaagaccctgtgcgccagagccgtggccaacagaaccgacgcctgcttcatcagagtgatcggcagcgagctggtgcagaagtacgtgggcgagggcgccagaatggtgagagagctgttcgagatggccagaaccaagaaggcctgcctgatcttcttcgacgagatcgacgccatcggcggcgccagattcgacgacggcgccggcggcgacaacgaggtgcagagaaccatgctggagctgatcaaccagctggacggcttcgaccccagaggcaacatcaaggtgctgatggccaccaacagacccgacaccctggaccccgccctgatgagacccggcagactggacagaaagatcgagttcagcctgcccgacctggagggcagaacccacatcttcaagatccacgccagaagcatgagcgtggagagagacatcagattcgagctgctggccagactgtgccccaacagcaccggcgccgagatcagaagcgtgtgcaccgaggccggcatgttcgccatcagagccagaagaaagatcgccaccgagaaggacttcctggaggccgtgaacaaggtgatcaagagctacgccaagttcagcgccacccccagatacatgacctacaactag

SEQ ID NO: 94860 - DNA, 393 bp, Artificial Sequence
  Description of Artificial Sequence: Synthetic coding sequence
atgcccgactacctgggcgccgaccagagaaagaccaaggaggacgagaaggacgacaagcccatcagagccctggacgagggcgacatcgccctgctgaagacctacggccagagcacctacagcagacagatcaagcaggtggaggacgacatccagcagctgctgaagaagatcaacgagctgaccggcatcaaggagagcgacaccggcctggccccccccgccctgtgggacctggccgccgacaagcagaccctgcagagcgagcagcccctgcaggtggccagatgcaccaagatcatcaacgccgacagcgaggaccccaagtacatcatcaacgtgaagcagttcgccaagttcgtggtggacctgagcgaccaggtggcctag

SEQ ID NO: 94861 - DNA, 1302 bp, Artificial Sequence; identical to SEQ ID NO: 94859
  Description of Artificial Sequence: Synthetic coding sequence

SEQ ID NO: 94862 - DNA, 393 bp, Artificial Sequence; identical to SEQ ID NO: 94860
  Description of Artificial Sequence: Synthetic coding sequence

SEQ ID NO: 94863 - DNA, 891 bp, Artificial Sequence
  Description of Artificial Sequence: Synthetic coding sequence
atgagagtgggcgtggacagaaacaagtaccagatccacatccccctgccccccaagatcgaccccaccgtgaccatgatgcaggtggaggagaagcccgacgtgacctacagcgacgtgggcggctgcaaggagcagatcgagaagctgagagaggtggtggagacccccctgctgcaccccgagagattcgtgaacctgggcatcgagccccccaagggcgtgctgctgttcggcccccccggcaccggcaagaccctgtgcgccagagccgtggccaacagaaccgacgcctgcttcatcagagtgatcggcagcgagctggtgcagaagtacgtgggcgagggcgccagaatggtgagagagctgttcgagatggccagaaccaagaaggcctgcctgatcttcttcgacgagatcgacgccatcggcggcgccagattcgacgacggcgccggcggcgacaacgaggtgcagagaaccatgctggagctgatcaaccagctggacggcttcgaccccagaggcaacatcaaggtgctgatggccaccaacagacccgacaccctggaccccgccctgatgagacccggcagactggacagaaagatcgagttcagcctgcccgacctggagggcagaacccacatcttcaagatccacgccagaagcatgagcgtggagagagacatcagattcgagctgctggccagactgtgccccaacagcaccggcgccgagatcagaagcgtgtgcaccgaggccggcatgttcgccatcagagccagaagaaagatcgccaccgagaaggacttcctggaggccgtgaacaaggtgatcaagagctacgccaagttcagcgccacccccagatacatgacctacaactag

SEQ ID NO: 94864 - DNA, 1320 bp, Artificial Sequence
  Description of Artificial Sequence: Synthetic coding sequence
atgaacctgctgcccaacatcgagagccccgtgaccagacaggagaagatggccaccgtgtgggacgaggccgagcaggacggcatcggcgaggaggtgctgaagatgagcaccgaggagatcatccagagaaccagactgctggacagcgagatcaagatcatgaagagcgaggtgctgagagtgacccacgagctgcaggccatgaaggacaagatcaaggagaacagcgagaagatcaaggtgaacaagaccctgccctacctggtgagcaacgtgatcgagctgctggacgtggaccccaacgaccaggaggaggacggcgccaacatcgacctggacagccagagaaagggcaagtgcgccgtgatcaagaccagcaccagacagacctacttcctgcccgtgatcggcctggtggacgccgagaagctgaagcccggcgacctggtgggcgtgaacaaggacagctacctgatcctggagaccctgcccaccgagtacgacagcagagtgaaggccatggaggtggacgagagacccaccgagcagtacagcgacatcggcggcctggacaagcagatccaggagctggtggaggccatcgtgctgcccatgaaccacaaggagaagttcgagaacctgggcatccagccccccaagggcgtgctgatgtacggcccccccggcaccggcaagaccctgctggccagagcctgcgccgcccagaccaaggccaccttcctgaagctggccggcccccagctggtgcagatgttcatcggcgacggcgccaagctggtgagagacgccttcgccctggccaaggagaaggcccccagcatcatcttcatcgacgagctggacgccatcggcaccaagagattcgacagcgagaaggccggcgacagagaggtgcagagaaccatgctggagctgctgaaccagctggacggcttccagcccaacacccaggtgaaggtgatcgccgccaccaacagagtggacatcctggaccccgccctgctgagaagcggcagactggacagaaagatcgagttccccatgcccaacgaggaggccagagccagaatcatgcagatccacagcagaaagatgaacgtgagccccgacgtgaactacgaggagctggccagatgcaccgacgacttcaacggcgcccagtgcaaggccgtgtgcgtggaggccggcatgatcgccctgagaagaggcgccaccgagctgacccacgaggactacatggagggcatcctggaggtgcaggccaagaagaaggccaacctgcagtactacgcctag

SEQ ID NO: 94865 - DNA, 1257 bp, Artificial Sequence
  Description of Artificial Sequence: Synthetic coding sequence
atggaggagatcggcatcctggtggagaaggcccaggacgagatccccgccctgagcgtgagcagaccccagaccggcctgagcttcctgggccccgagcccgaggacctggaggacctgtacagcagatacaagaagctgcagcaggagctggagttcctggaggtgcaggaggagtacatcaaggacgagcagaagaacctgaagaaggagttcctgcacgcccaggaggaggtgaagagaatccagagcatccccctggtgatcggccagttcctggaggccgtggaccagaacaccgccatcgtgggcagcaccaccggcagcaactactacgtgagaatcctgagcaccatcgacagagagctgctgaagcccaacgccagcgtggccctgcacaagcacagcaacgccctggtggacgtgctgccccccgaggccgacagcagcatcatgatgctgaccagcgaccagaagcccgacgtgatgtacgccgacatcggcggcatggacatccagaagcaggaggtgagagaggccgtggagctgcccctgacccacttcgagctgtacaagcagatcggcatcgacccccccagaggcgtgctgatgtacggcccccccggctgcggcaagaccatgctggccaaggccgtggcccaccacaccaccgccgccttcatcagagtggtgggcagcgagttcgtgcagaagtacctgggcgagggccccagaatggtgagagacgtgttcagactggccaaggagaacgcccccgccatcatcttcatcgacgagatcgacgccatcgccaccaagagattcgacgcccagaccggcgccgacagagaggtgcagagaatcctgctggagctgctgaaccagatggacggcttcgaccagaacgtgaacgtgaaggtgatcatggccaccaacagagccgacaccctggaccccgccctgctgagacccggcagactggacagaaagatcgagttccccctgcccgacagaagacagaagagactgatcttcagcaccatcaccagcaagatgaacctgagcgaggaggtggacctggaggactacgtggccagacccgacaagatcagcggcgccgacatcaacagcatctgccaggagagcggcatgctggccgtgagagagaacagatacatcgtgctggccaaggacttcgagaaggcctacaagaccgtgatcaagaaggacgagcaggagcacgagttctacaagtag

SEQ ID NO: 94866 - DNA, 1164 bp, Artificial Sequence
  Description of Artificial Sequence: Synthetic coding sequence
atggaggagatcggcatcctggtggagaaggcccaggacgagatccccgccctgagcgtgagcagaccccagaccggcctgagcttcctgggccccgagcccgaggacctggaggacctgtacagcagatacaaggaggaggtgaagagaatccagagcatccccctggtgatcggccagttcctggaggccgtggaccagaacaccgccatcgtgggcagcaccaccggcagcaactactacgtgagaatcctgagcaccatcgacagagagctgctgaagcccaacgccagcgtggccctgcacaagcacagcaacgccctggtggacgtgctgccccccgaggccgacagcagcatcatgatgctgaccagcgaccagaagcccgacgtgatgtacgccgacatcggcggcatggacatccagaagcaggaggtgagagaggccgtggagctgcccctgacccacttcgagctgtacaagcagatcggcatcgacccccccagaggcgtgctgatgtacggcccccccggctgcggcaagaccatgctggccaaggccgtggcccaccacaccaccgccgccttcatcagagtggtgggcagcgagttcgtgcagaagtacctgggcgagggccccagaatggtgagagacgtgttcagactggccaaggagaacgcccccgccatcatcttcatcgacgagatcgacgccatcgccaccaagagattcgacgcccagaccggcgccgacagagaggtgcagagaatcctgctggagctgctgaaccagatggacggcttcgaccagaacgtgaacgtgaaggtgatcatggccaccaacagagccgacaccctggaccccgccctgctgagacccggcagactggacagaaagatcgagttccccctgcccgacagaagacagaagagactgatcttcagcaccatcaccagcaagatgaacctgagcgaggaggtggacctggaggactacgtggccagacccgacaagatcagcggcgccgacatcaacagcatctgccaggagagcggcatgctggccgtgagagagaacagatacatcgtgctggccaaggacttcgagaaggcctacaagaccgtgatcaagaaggacgagcaggagcacgagttctacaagtag

SEQ ID NO: 94867 - DNA, 1221 bp, Artificial Sequence
  Description of Artificial Sequence: Synthetic coding sequence
atggccctggacggccccgagcagatggagctggaggagggcaaggccggcagcggcctgagacagtactacctgagcaagatcgaggagctgcagctgatcgtgaacgacaagagccagaacctgagaagactgcaggcccagagaaacgagctgaacgccaaggtgagactgctgagagaggagctgcagctgctgcaggagcagggcagctacgtgggcgaggtggtgagagccatggacaagaagaaggtgctggtgaaggtgcaccccgagggcaagttcgtggtggacgtggacaagaacatcgacatcaacgacgtgacccccaactgcagagtggccctgagaaacgacagctacaccctgcacaagatcctgcccaacaaggtggaccccctggtgagcctgatgatggtggagaaggtgcccgacagcacctacgagatgatcggcggcctggacaagcagatcaaggagatcaaggaggtgatcgagctgcccgtgaagcaccccgagctgttcgaggccctgggcatcgcccagcccaagggcgtgctgctgtacggcccccccggcaccggcaagaccctgctggccagagccgtggcccaccacaccgactgcaccttcatcagagtgagcggcagcgagctggtgcagaagttcatcggcgagggcgccagaatggtgagagagctgttcgtgatggccagagagcacgcccccagcatcatcttcatggacgagatcgacagcatcggcagcagcagactggagggcggcagcggcggcgacagcgaggtgcagagaaccatgctggagctgctgaaccagctggacggcttcgaggccaccaagaacatcaaggtgatcatggccaccaacagaatcgacatcctggacagcgccctgctgagacccggcagaatcgacagaaagatcgagttccccccccccaacgaggaggccagactggacatcctgaagatccacagcagaaagatgaacctgaccagaggcatcaacctgagaaagatcgccgagctgatgcccggcgccagcggcgccgaggtgaagggcgtgtgcaccgaggccggcatgtacgccctgagagagagaagagtgcacgtgacccaggaggacttcgagatggccgtggccaaggtgatgcagaaggacagcgagaagaacatgagcatcaagaagctgtggaagtag

SEQ ID NO: 94868 - DNA, 1197 bp, Artificial Sequence; identical to SEQ ID NO: 94855
  Description of Artificial Sequence: Synthetic coding sequence

SEQ ID NO: 94869 - DNA, 1212 bp, Artificial Sequence
  Description of Artificial Sequence: Synthetic coding sequence
atggccatccccggcatcccctacgagagaagactgctgatcatggccgaccccagagacaaggccctgcaggactacagaaagaagctgctggagcacaaggagatcgacggcagactgaaggagctgagagagcagctgaaggagctgaccaagcagtacgagaagagcgagaacgacctgaaggccctgcagagcgtgggccagatcgtgggcgaggtgctgaagcagctgaccgaggagaagttcatcgtgaaggccaccaacggccccagatacgtggtgggctgcagaagacagctggacaagagcaagctgaagcccggcaccagagtggccctggacatgaccaccctgaccatcatgagatacctgcccagagaggtggaccccctggtgtacaacatgagccacgaggaccccggcaacgtgagctacagcgagatcggcggcctgagcgagcagatcagagagctgagagaggtgatcgagctgcccctgaccaaccccgagctgttccagagagtgggcatcatcccccccaagggctgcctgctgtacggcccccccggcaccggcaagaccctgctggccagagccgtggccagccagctggactgcaacttcctgaaggtggtgagcagcagcatcgtggacaagtacatcggcgagagcgccagactgatcagagagatgttcaactacgccagagaccaccagccctgcatcatcttcatggacgagatcgacgccatcggcggcagaagattcagcgagggcaccagcgccgacagagagatccagagaaccctgatggagctgctgaaccagatggacggcttcgacaccctgcacagagtgaagatgatcatggccaccaacagacccgacaccctggaccccgccctgctgagacccggcagactggacagaaagatccacatcgacctgcccaacgagcaggccagactggacatcctgaagatccacgccggccccatcaccaagcacggcgagatcgactacgaggccatcgtgaagctgagcgacggcttcaacggcgccgacctgagaaacgtgtgcaccgaggccggcatgttcgccatcagagccgaccacgacttcgtggtgcaggaggacttcatgaaggccgtgagaaaggtggccgacagcaagaagctggagagcaagctggactacaagcccgtgtag

SEQ ID NO: 94870 - DNA, 933 bp, Artificial Sequence
  Description of Artificial Sequence: Synthetic coding sequence
atggacagactgctgagactgggcggcggcatgcccggcctgggccagggcccccccaccgacgcccccgccgtggacaccgccgagcaggtgtacatcagcagcctggccctgctgaagatgctgaagcacggcagagccggcgtgcccatggaggtgatgggcctgatgctgggcgagttcgtggacgactacaccgtgagagtgatcgacgtgttcgccatgccccagagcggcaccggcgtgagcgtggaggccgtggaccccgtgttccaggccaagatgctggacatgctgaagcagaccggcagacccgagatggtggtgggctggtaccacagccaccccggcttcggctgctggctgagcggcgtggacatcaacacccagcagagcttcgaggccctgagcgagagagccgtggccgtggtggtggaccccatccagagcgtgaagggcaaggtggtgatcgacgccttcagactgatcaacgccaacatgatggtgctgggccacgagcccagacagaccaccagcaacctgggccacctgaacaagcccagcatccaggccctgatccacggcctgaacagacactactacagcatcaccatcaactacagaaagaacgagctggagcagaagatgctgctgaacctgcacaagaagagctggatggagggcctgaccctgcaggactacagcgagcactgcaagcacaacgagagcgtggtgaaggagatgctggagctggccaagaactacaacaaggccgtggaggaggaggacaagatgacccccgagcagctggccatcaagaacgtgggcaagcaggaccccaagagacacctggaggagcacgtggacgtgctgatgaccagcaacatcgtgcagtgcctggccgccatgctggacaccgtggtgttcaagtag

SEQ ID NO: 94871 - DNA, 255 bp, Artificial Sequence
  Description of Artificial Sequence: Synthetic coding sequence
atggacagactgctgagactgggcggcggcatgcccggcctgggccagggcccccccaccgacgcccccgccgtggacaccgccgagcaggtgtacatcagcagcctggccctgctgaagatgctgaagcacggcagagccggcgtgcccatggaggtgatgggcctgatgctgggcgagttcgtggacgactacaccgtgagagtgatcgacgtgttcgccatgccccagagcggcaccggcgtgagcgtgtag

SEQ ID NO: 94872 - DNA, 2727 bp, Artificial Sequence
  Description of Artificial Sequence: Synthetic coding sequence
atggaggagggcggcagagacaaggcccccgtgcagccccagcagagccccgccgccgcccccggcggcaccgacgagaagcccagcggcaaggagagaagagacgccggcgacaaggacaaggagcaggagctgagcgaggaggacaagcagctgcaggacgagctggagatgctggtggagagactgggcgagaaggacaccagcctgtacagacccgccctggaggagctgagaagacagatcagaagcagcaccaccagcatgaccagcgtgcccaagcccctgaagttcctgagaccccactacggcaagctgaaggagatctacgagaacatggcccccggcgagaacaagagattcgccgccgacatcatcagcgtgctggccatgaccatgagcggcgagagagagtgcctgaagtacagactggtgggcagccaggaggagctggccagctggggccacgagtacgtgagacacctggccggcgaggtggccaaggagtggcaggagctggacgacgccgagaaggtgcagagagagcccctgctgaccctggtgaaggagatcgtgccctacaacatggcccacaacgccgagcacgaggcctgcgacctgctgatggagatcgagcaggtggacatgctggagaaggacatcgacgagaacgcctacgccaaggtgtgcctgtacctgaccagctgcgtgaactacgtgcccgagcccgagaacagcgccctgctgagatgcgccctgggcgtgttcagaaagttcagcagattccccgaggccctgagactggccctgatgctgaacgacatggagctggtggaggacatcttcaccagctgcaaggacgtggtggtgcagaagcagatggccttcatgctgggcagacacggcgtgttcctggagctgagcgaggacgtggaggagtacgaggacctgaccgagatcatgagcaacgtgcagctgaacagcaacttcctggccctggccagagagctggacatcatggagcccaaggtgcccgacgacatctacaagacccacctggagaacaacagattcggcggcagcggcagccaggtggacagcgccagaatgaacctggccagcagcttcgtgaacggcttcgtgaacgccgccttcggccaggacaagctgctgaccgacgacggcaacaagtggctgtacaagaacaaggaccacggcatgctgagcgccgccgccagcctgggcatgatcctgctgtgggacgtggacggcggcctgacccagatcgacaagtacctgtacagcagcgaggactacatcaagagcggcgccctgctggcctgcggcatcgtgaacagcggcgtgagaaacgagtgcgaccccgccctggccctgctgagcgactacgtgctgcacaacagcaacaccatgagactgggcagcatcttcggcctgggcctggcctacgccggcagcaacagagaggacgtgctgaccctgctgctgcccgtgatgggcgacagcaagagcagcatggaggtggccggcgtgaccgccctggcctgcggcatgatcgccgtgggcagctgcaacggcgacgtgaccagcaccatcctgcagaccatcatggagaagagcgagaccgagctgaaggacacctacgccagatggctgcccctgggcctgggcctgaaccacctgggcaagggcgaggccatcgaggccatcctggccgccctggaggtggtgagcgagcccttcagaagcttcgccaacaccctggtggacgtgtgcgcctacgccggcagcggcaacgtgctgaaggtgcagcagctgctgcacatctgcagcgagcacttcgacagcaaggagaaggaggaggacaaggacaagaaggagaagaaggacaaggacaagaaggaggcccccgccgacatgggcgcccaccagggcgtggccgtgctgggcatcgccctgatcgccatgggcgaggagatcggcgccgagatggccctgagaaccttcggccacctgctgagatacggcgagcccaccctgagaagagccgtgcccctggccctggccctgatcagcgtgagcaaccccagactgaacatcctggacaccctgagcaagttcagccacgacgccgaccccgaggtgagctacaacagcatcttcgccatgggcatggtgggcagcggcaccaacaacgccagactggccgccatgctgagacagctggcccagtaccacgccaaggaccccaacaacctgttcatggtgagactggcccagggcctgacccacctgggcaagggcaccctgaccctgtgcccctaccacagcgacagacagctgatgagccaggtggccgtggccggcctgctgaccgtgctggtgagcttcctggacgtgagaaacatcatcctgggcaagagccactacgtgctgtacggcctggtggccgccatgcagcccagaatgctggtgaccttcgacgaggagctgagacccctgcccgtgagcgtgagagtgggccaggccgtggacgtggtgggccaggccggcaagcccaagaccatcaccggcttccagacccacaccacccccgtgctgctggcccacggcgagagagccgagctggccaccgaggagttcctgcccgtgacccccatcctggagggcttcgtgatcctgagaaagaaccccaactacgacctgtag

SEQ ID NO: 94873 - DNA, 1743 bp, Artificial Sequence
  Description of Artificial Sequence: Synthetic coding sequence
cagtgcaccgcccagcagcagctgctgggcctgagcagcggcgccggccaccacggcgcccagctgatgctgcagaacccccccagagagcagcaggtgtggggccagtggctgagcggcggcctgtgcccccacgagcccggcctgctgttctgcgagtggctgtgcgagtgcagcttctgggacaagctgctgaccgacgacggcaacaagtggctgtacaagaacaaggaccacggcatgctgagcgccgccgccagcctgggcatgatcctgctgtgggacgtggacggcggcctgacccagatcgacaagtacctgtacagcagcgaggactacatcaagagcggcgccctgctggcctgcggcatcgtgaacagcggcgtgagaaacgagtgcgaccccgccctggccctgctgagcgactacgtgctgcacaacagcaacaccatgagactgggcagcatcttcggcctgggcctggcctacgccggcagcaacagagaggacgtgctgaccctgctgctgcccgtgatgggcgacagcaagagcagcatggaggtggccggcgtgaccgccctggcctgcggcatgatcgccgtgggcagctgcaacggcgacgtgaccagcaccatcctgcagaccatcatggagaagagcgagaccgagctgaaggacacctacgccagatggctgcccctgggcctgggcctgaaccacctgggcaagggcgaggccatcgaggccatcctggccgccctggaggtggtgagcgagcccttcagaagcttcgccaacaccctggtggacgtgtgcgcctacgccggcagcggcaacgtgctgaaggtgcagcagctgctgcacatctgcagcgagcacttcgacagcaaggagaaggaggaggacaaggacaagaaggagaagaaggacaaggacaagaaggaggcccccgccgacatgggcgcccaccagggcgtggccgtgctgggccccctgctgctgtggggcagaagactggtgcagagatggcactacgagccctaccaccagctgagatacggcgagcccaccctgagaagagccgtgcccctggccctggccctgatcagcgtgagcaaccccagactgaacatcctggacaccctgagcaagttcagccacgacgccgaccccgaggtgagctacaacagcatcttcgccatgggcatggtgggcagcggcaccaacaacgccagactggccgccatgctgagacagctggcccagtaccacgccaaggaccccaacaacctgttcatggtgagactggcccagggcctgacccacctgggcaagggcaccctgaccctgtgcccctaccacagcgacagacagctgatgagccaggtggccgtggccggcctgctgaccgtgctggtgagcttcctggacgtgagaaacatcatcctgggcaagagccactacgtgctgtacggcctggtggccgccatgcagcccagaatgctggtgaccttcgacgaggagctgagacccctgcccgtgagcgtgagagtgggccaggccgtggacgtggtgggccaggccggcaagcccaagaccatcaccggcttccagacccacaccacccccgtgctgctggcccacggcgagagagccgagctggccaccgaggagttcctgcccgtgacccccatcctggagggcttcgtgttcggcagaacccccatcatgatcagcaagtag

SEQ ID NO: 94874 - DNA, 2703 bp, Artificial Sequence
  Description of Artificial Sequence: Synthetic coding sequence
atggaggagggcggcagagacaaggcccccgtgcagccccagcagagccccgccgccgcccccggcggcaccgacgagaagcccagcggcaaggacaaggagcaggagctgagcgaggaggacaagcagctgcaggacgagctggagatgctggtggagagactgggcgagaaggacaccagcctgtacagacccgccctggaggagctgagaagacagatcagaagcagcaccaccagcatgaccagcgtgcccaagcccctgaagttcctgagaccccactacggcaagctgaaggagatctacgagaacatggcccccggcgagaacaagagattcgccgccgacatcatcagcgtgctggccatgaccatgagcggcgagagagagtgcctgaagtacagactggtgggcagccaggaggagctggccagctggggccacgagtacgtgagacacctggccggcgaggtggccaaggagtggcaggagctggacgacgccgagaaggtgcagagagagcccctgctgaccctggtgaaggagatcgtgccctacaacatggcccacaacgccgagcacgaggcctgcgacctgctgatggagatcgagcaggtggacatgctggagaaggacatcgacgagaacgcctacgccaaggtgtgcctgtacctgaccagctgcgtgaactacgtgcccgagcccgagaacagcgccctgctgagatgcgccctgggcgtgttcagaaagttcagcagattccccgaggccctgagactggccctgatgctgaacgacatggagctggtggaggacatcttcaccagctgcaaggacgtggtggtgcagaagcagatggccttcatgctgggcagacacggcgtgttcctggagctgagcgaggacgtggaggagtacgaggacctgaccgagatcatgagcaacgtgcagctgaacagcaacttcctggccctggccagagagctggacatcatggagcccaaggtgcccgacgacatctacaagacccacctggagaacaacagattcggcggcagcggcagccaggtggacagcgccagaatgaacctggccagcagcttcgtgaacggcttcgtgaacgccgccttcggccaggacaagctgctgaccgacgacggcaacaagtggctgtacaagaacaaggaccacggcatgctgagcgccgccgccagcctgggcatgatcctgctgtgggacgtggacggcggcctgacccagatcgacaagtacctgtacagcagcgaggactacatcaagagcggcgccctgctggcctgcggcatcgtgaacagcggcgtgagaaacgagtgcgaccccgccctggccctgctgagcgactacgtgctgcacaacagcaacaccatgagactgggcagcatcttcggcctgggcctggcctacgccggcagcaacagagaggacgtgctgaccctgctgctgcccgtgatgggcgacagcaagagcagcatggaggtggccggcgtgaccgccctggcctgcggcatgatcgccgtgggcagctgcaacggcgacgtgaccagcaccatcctgcagaccatcatggagaagagcgagaccgagctgaaggacacctacgccagatggctgcccctgggcctgggcctgaaccacctgggcaagggcgaggccatcgaggccatcctggccgccctggaggtggtgagcgagcccttcagaagcttcgccaacaccctggtggacgtgtgcgcctacgccggcagcggcaacgtgctgaaggtgcagcagctgctgcacatctgcagcgagcacttcgacagcaaggagaaggaggaggacaaggacaagaaggagaagaaggacaaggacaagaaggaggcccccgccgacatgggcgcccaccagggcgtggccgtgctgggcatcgccctgatcgccatgggcgaggagatcggcgccgagatggccctgagaaccttcggccacctgctgagatacggcgagcccaccctgagaagagccgtgcccctggccctggccctgatcagcgtgagcaaccccagactgaacatcctggacaccctgagcaagttcagccacgacgccgaccccgaggtgagctacaacagcatcttcgccatgggcatggtgggcagcggcaccaacaacgccagactggccgccatgctgagacagctggcccagtaccacgccaaggaccccaacaacctgttcatggtgagactggcccagggcctgacccacctgggcaagggcaccctgaccctgtgcccctaccacagcgacagacagctgatgagccaggtggccgtggccggcctgctgaccgtgctggtgagcttcctggacgtgagaaacatcatcctgggcaagagccactacgtgctgtacggcctggtggccgccatgcagcccagaatgctggtgaccttcgacgaggagctgagacccctgcccgtgagcgtgagagtgggccaggccgtggacgtggtgggccaggccggcaagcccaagaccatcaccggcttccagacccacaccacccccgtgctgctggcccacggcgagagagccgagctggccaccgaggagttcctgcccgtgacccccatcctggagggcttcgtgatcctgagaaagaaccccaactacgacctgtag

SEQ ID NO: 94875 - DNA, 552 bp, Artificial Sequence
  Description of Artificial Sequence: Synthetic coding sequence
atggacgccagccccagccccttcagcctgcccaagaagctgaacgagctgagcgccagaagaggcagcgacgagctgctgagcagcggcatcatcaacggccccttcaccatgaacagcagcacccccagcaccgccaacggcaacgacagcaagaagttcaagagagacagacccccctgcagccccagcagagtgctgcacctgagaaagatcccctgcgacgtgaccgaggccgagatcatcagcctgggcctgcccttcggcaaggtgaccaacctgctgatgctgaagggcaagagccaggccttcctggagatggccagcgaggaggccgccgtgaccatggtgaactactacacccccatcaccccccacctgagaagccagcccgtgtacatccagtacagcaaccacagagagctgaagaccgacaacctgcccaaccaggccagagcccaggccgccctgcaggccgtgagcgccgtgcagagcggcagcctggccctgagcggcggccccagcaacgagggcaccgtgctgcccggctag

SEQ ID NO: 94876 - DNA, 474 bp, Artificial Sequence
  Description of Artificial Sequence: Synthetic coding sequence
atggtgaccagcctggcctacacccaccacggcagacagtacctggcccaggagggcgtgatcgaccagatcagcaacatcatcgtgggcgccgacagcgaccccttcagcagcttctacctgcccggcttcgtgaagttcttcggcaacctggccgtgatggacagcccccagcagatctgcgagagataccccatcttcgtggagaaggtgttcgagatgatcgagagccaggaccccaccatgatcggcgtggccgtggacaccgtgggcatcctgggcagcaacgtggagggcaagcaggtgctgcagaagaccggctggtacgacctggccctgttcagagacatcctgatcttcgacagaggcagcatctgcaagttcatctgctggtgggtgaactacatcgtggagaccatcctgtgggtggccgtgctgctgaccatgaccctgtacagctgcctgaagatctag

SEQ ID NO: 94877 - DNA, 1386 bp, Artificial Sequence
  Description of Artificial Sequence: Synthetic coding sequence
atggccgcccaggccctggccctgctgagagaggtggccagactggaggcccccctggaggagctgagagccctgcacagcgtgctgcaggccgtgcccctgaacgagctgagacagcaggccgccgagctgagactgggccccctgttcagcctgctgaacgagaaccacagagagaagaccaccctgtgcgtgagcatcctggagagactgctgcaggccatggagcccgtgcacgtggccagaaacctgagagtggacctgcagagaggcctgatccaccccgacgacagcgtgaagatcctgaccctgagccagatcggcagaatcgtggagaacagcgacgccgtgaccgagatcctgaacaacgccgagctgctgaagcagatcgtgtactgcatcggcggcgagaacctgagcgtggccaaggccctgatcatcgagatcagcagcgtgagccccgagagcctgaactactgcaccaccagcggcctggtgacccagctgctgagagagctgaccggcgaggacgtgctggtgagagccacctgcatcgagatggtgaccagcctggcctacacccaccacggcagacagtacctggcccaggagggcgtgatcgaccagatcagcaacatcatcgtgggcgccgacagcgaccccttcagcagcttctacctgcccggcttcgtgaagttcttcggcaacctggccgtgatggacagcccccagcagatctgcgagagataccccatcttcgtggagaaggtgttcgagatgatcgagagccaggaccccaccatgatcggcgtggccgtggacaccgtgggcatcctgggcagcaacgtggagggcaagcaggtgctgcagaagaccggcaccagattcgagagactgctgatgagaatcggccaccagagcaagaacgcccccgtggagctgaagatcagatgcctggacgccatcagcagcctgctgtacctgccccccgagcagcagaccgacgacctgctgagaatgaccgagagctggttcagcagcctgagcagagaccccctggagctgttcagaggcatcagcagccagcccttccccgagctgcactgcgccgccctgaaggtgttcaccgccatcgccaaccagccctgggcccagaagctgatgttcaacagccccggcttcgtggagtacgtggtggacagaagcgtggagcacgacaaggccagcaaggacgccaagtacgagctggtgaaggccctggccaacagcaagaccatcgccgagatcttcggcaaccccaactacctgagactgagaacctacctgagcgagggcccctactacgtgaagcccgtgagcaccaccgccgtggagggcgccgagtag

SEQ ID NO: 94878 - DNA, 294 bp, Artificial Sequence
  Description of Artificial Sequence: Synthetic coding sequence
atgagaatcggccaccagagcaagaacgcccccgtggagctgaagatcagatgcctggacgccatcagcagcctgctgtacctgccccccgagcagcagaccgacgacctgctgagaatgaccgagagctggttcagcagcctgagcagagaccccctggagctgttcagaggcatcagcagccagcccttccccgagctgcactgcgccgccctgaaggtgttcaccggcagaaagcacctgcacctggaggagctggtgggcggcaaccaggtgaagaacaccgtggagtag

SEQ ID NO: 94879 - DNA, 510 bp, Artificial Sequence
  Description of Artificial Sequence: Synthetic coding sequence
atgatctgcctggtgctgaccatcttcgccaacctgttccccgccgcctgcaccggcgcccacgagagaaccttcctggccgtgaagcccgacggcgtgcagagaagactggtgggcgagatcgtgagaagattcgagagaaagggcttcaagctggtggccctgaagctggtgcaggccagcgaggagctgctgagagagcactacgccgagctgagagagagacccttctacggcagactggtgaagtacatggccagcggccccgtggtggccatggtgtggcagggcctggacgtggtgagaaccagcagagccctgatcggcgccaccaaccccgccgacgccccccccggcaccatcagaggcgacttctgcatcgaggtgggcaagaacctgatccacggcagcgacagcgtggagagcgccagaagagagatcgccctgtggttcagagccgacgagctgctgtgctgggaggacagcgccggccactggctgtacgagtag

SEQ ID NO: 94880 - DNA, 744 bp, Artificial Sequence
  Description of Artificial Sequence: Synthetic coding sequence
atgtacggcatgttcaagaaggtgaacgccagagagagaatcgtgggctggtaccacaccggccccaagctgcacaagaacgacatcgccatcaacgagctgatgaagagatactgccccaacagcgtgctggtgatcatcgacgtgaagcccaaggacctgggcctgcccaccgaggcctacatcagcgtggaggaggtgcacgacgacggcacccccaccagcaagaccttcgagcacgtgaccagcgagatcggcgccgaggaggccgaggaggtgggcgtggagcacctgctgagagacatcaaggacaccaccgtgggcaccctgagccagagaatcaccaaccaggtgcacggcctgaagggcctgaacagcaagctgctggacatcagaagctacctggagaaggtggccaccggcaagctgcccatcaaccaccagatcatctaccagctgcaggacgtgttcaacctgctgcccgacgtgagcctgcaggagttcgtgaaggccttctacctgaagaccaacgaccagatggtggtggtgtacctggccagcctgatcagaagcgtggtggccctgcacaacctgatcaacaacaagatcgccaacagagacgccgagaagaaggagggccaggagaaggaggagagcaagaaggacagaaaggaggacaaggagaaggacaaggacaaggagaagagcgacgtgaagaaggaggagaagaaggagaagaagtag

SEQ ID NO: 94881 - DNA, 624 bp, Artificial Sequence
  Description of Artificial Sequence: Synthetic coding sequence
atgagcgacgaggaggccagacagagcggcggcagcagccaggccggcgtggtgaccgtgagcgacgtgcaggagctgatgagaagaaaggaggagatcgaggcccagatcaaggccaactacgacgtgctggagagccagaagggcatcggcatgaacgagcccctggtggactgcgagggctaccccagaagcgacgtggacctgtaccaggtgagaaccgccagacacaacatcatctgcctgcagaacgaccacaaggccgtgatgaagcaggtggaggaggccctgcaccagctgcacgccagagacaaggagaagcaggccagagacatggccgaggcccacaaggaggccatgagcagaaagctgggccagagcgagagccagggcccccccagagccttcgccaaggtgaacagcatcagccccggcagccccgccagcatcgccggcctgcaggtggacgacgagatcgtggagttcggcagcgtgaacacccagaacttccagagcctgcacaacatcggcagcgtggtgcagcacagcgagggcgccctggcccccaccatcctgctgagcgtgagcatgaacctgaccacccccggcaccagcagcagatag

SEQ ID NO: 94882 - DNA, 672 bp, Artificial Sequence
  Description of Artificial Sequence: Synthetic coding sequence
atgagcgacgaggaggccagacagagcggcggcagcagccaggccggcgtggtgaccgtgagcgacgtgcaggagctgatgagaagaaaggaggagatcgaggcccagatcaaggccaactacgacgtgctggagagccagaagggcatcggcatgaacgagcccctggtggactgcgagggctaccccagaagcgacgtggacctgtaccaggtgagaaccgccagacacaacatcatctgcctgcagaacgaccacaaggccgtgatgaagcaggtggaggaggccctgcaccagctgcacgccagagacaaggagaagcaggccagagacatggccgaggcccacaaggaggccatgagcagaaagctgggccagagcgagagccagggcccccccagagccttcgccaaggtgaacagcatcagccccggcagccccgccagcatcgccggcctgcaggtggacgacgagatcgtggagttcggcagcgtgaacacccagaacttccagagcctgcacaacatcggcagcgtggtgcagcacagcgagggcaagcccctgaacgtgaccgtgatcagaagaggcgagaagcaccagctgagactggtgcccaccagatgggccggcaagggcctgctgggctgcaacatcatccccctgcagagatag

SEQ ID NO: 94883 - DNA, 411 bp, Artificial Sequence
  Description of Artificial Sequence: Synthetic coding sequence
atgctgctgaagctgaaggagaaggccagcctgaccctggccgtgggcaccctgcccttccccagccagttcaacttcgtgccccccggcagaatgtgcagagtggccggctggggcagaaccggcgtgctgaagcccggcagcgacaccctgcaggaggtgaagctgagactgatggacccccaggcctgcagccacttcagagacttcgaccacaacctgcagctgtgcgtgggcaaccccagaaagaccaagagcgccttcaagggcgacagcggcggccccctgctgtgcgccggcgtggcccagggcatcgtgagctacggcagaagcgacgccaagccccccgccgtgttcaccagaatcagccactacagaccctggatcaaccagatcctgcaggccaactag

SEQ ID NO: 94884 - DNA, 753 bp, Artificial Sequence
  Description of Artificial Sequence: Synthetic coding sequence
atggccatgctgagagtgcagcccgaggcccaggccaaggtggacgtgttcagagaggacctgtgcaccaagaccgagaacctgctgggcagctacttccccaagaagatcagcgagctggacgccttcctgaaggagcccgccctgaacgaggccaacctgagcaacctgaaggcccccctggacatccccgtgcccgaccccgtgaaggagaaggagaaggaggagagaaagaagcagcaggagaaggaggacaaggacgagaagaagaagggcgaggacgaggacaagggccccccctgcggccccgtgaactgcaacgagaagatcgtggtgctgctgcagagactgaagcccgagatcaaggacgtgatcgagcagctgaacctggtgaccacctggctgcagctgcagatccccagaatcgaggacggcaacaacttcggcgtggccgtgcaggagaaggtgttcgagctgatgaccagcctgcacaccaagctggagggcttccacacccagatcagcaagtacttcagcgagagaggcgacgccgtgaccaaggccgccaagcagccccacgtgggcgactacagacagctggtgcacgagctggacgaggccgagtacagagacatcagactgatggtgatggagatcagaaacgcctacgtgagaagacagggccagggcagaggcggccagagacagctgagccaggccacccacagcctgaccctgcaggccagaggctag

SEQ ID NO: 94885 - DNA, 627 bp, Artificial Sequence
  Description of Artificial Sequence: Synthetic coding sequence
atgggcgaggtggagatcagcgccctggcctacgtgaagatgtgcctgcacgccgccagatacccccacgccgccgtgaacggcctgttcctggcccccgcccccagaagcggcgagtgcctgtgcctgaccgactgcgtgcccctgttccacagccacctggccctgagcgtgatgctggaggtggccctgaaccaggtggacgtgtggggcgcccaggccggcctggtggtggccggctactaccacgccaacgccgccgtgaacgaccagagccccggccccctggccctgaagatcgccggcagaatcgccgagttcttccccgacgccgtgctgatcatgctggacaaccagaagctggtgccccagcccagagtgccccccgtgatcgtgctggagaaccagggcctgagatgggtgcccaaggacaagaacctggtgatgtggagagactgggaggagagcagacagatggtgggcgccctgctggaggacagagcccaccagcacctggtggacttcgactgccacctggacgacatcagacaggactggaccaaccagagactgaacacccagatcacccagtgggtgggccccaccaacggcaacggcaacgcctag

SEQ ID NO: 94886 - DNA, 804 bp, Artificial Sequence
  Description of Artificial Sequence: Synthetic coding sequence
atggccagcctgctgaaggtggaccaggaggtgaagctgaaggtggacagcttcagagagagaatcaccagcgaggccgaggacctggtggccaacttcttccccaagaagctgctggagctggacagcttcctgaaggagcccatcctgaacatccacgacctgacccagatccacagcgacatgaacctgcccgtgcccgaccccatcctgctgaccaacagccacgacggcctggacggccccacctacaagaagagaagactggacgagtgcgaggaggccttccagggcaccaaggtgttcgtgatgcccaacggcatgctgaagagcaaccagcagctggtggacatcatcgagaaggtgaagcccgagatcagactgctgatcgagaagtgcaacacccccagcggcaagggcccccacatctgcttcgacctgcaggtgaagatgtgggtgcagctgctgatccccagaatcgaggacggcaacaacttcggcgtgagcatccaggaggagaccgtggccgagctgagaaccgtggagagcgaggccgccagctacctggaccagatcagcagatactacatcaccagagccaagctggtgagcaagatcgccaagtacccccacgtggaggactacagaagaaccgtgaccgagatcgacgagaaggagtacatcagcctgagactgatcatcagcgagctgagaaaccagtacgtgaccctgcacgacatgatcctgaagaacatcgagaagatcaagagacccagaagcagcaacgccgagaccctgtactag

SEQ ID NO: 94887 - DNA, 765 bp, Artificial Sequence; identical to SEQ ID NO: 94856
  Description of Artificial Sequence: Synthetic coding sequence

SEQ ID NO: 94888 - DNA, 48 bp, Artificial Sequence
  Description of Artificial Sequence: Synthetic coding sequence
atggccagcctgctgaaggtggaccaggaggtgaagctgaagctgtag

SEQ ID NO: 94889 - DNA, 393 bp, Artificial Sequence
  Description of Artificial Sequence: Synthetic coding sequence
atggccagcctgctgaaggtggaccaggaggtgaagctgaaggtggacagcttcagagagagaatcaccagcgaggccgaggacctggtggccaacttcttccccaagaagctgctggagctggacagcttcctgaaggagcccatcctgaacatccacgacctgacccagatccacagcgacatgaacctgcccgtgcccgaccccatcctgctgaccaacagccacgacggcctggacggccccacctacaagaagagaagactggacgagtgcgaggaggccttccagggccagaacgtgggcaccgcccccgacagccaggacagaagatggaagcagctgtggggcgtgcacagcggcggcaacagctgcagagccaagaactgctag

SEQ ID NO: 94890 - DNA, 582 bp, Artificial Sequence
  Description of Artificial Sequence: Synthetic coding sequence
atgaacctgcccgtgcccgaccccatcctgctgaccaacagccacgacggcctggacggccccacctacaagaagagaagactggacgagtgcgaggaggccttccagggcaccaaggtgttcgtgatgcccaacggcatgctgaagagcaaccagcagctggtggacatcatcgagaaggtgaagcccgagatcagactgctgatcgagaagtgcaacaccgtgaagatgtgggtgcagctgctgatccccagaatcgaggacggcaacaacttcggcgtgagcatccaggaggagaccgtggccgagctgagaaccgtggagagcgaggccgccagctacctggaccagatcagcagatactacatcaccagagccaagctggtgagcaagatcgccaagtacccccacgtggaggactacagaagaaccgtgaccgagatcgacgagaaggagtacatcagcctgagactgatcatcagcgagctgagaaaccagtacgtgaccctgcacgacatgatcctgaagaacatcgagaagatcaagagacccagaagcagcaacgccgagaccctgtactag

SEQ ID NO: 94891 - DNA, 5532 bp, Artificial Sequence
  Description of Artificial Sequence: Synthetic coding sequence
atggagcccgccgagagagccggcgtgggcgagccccccgagcccggcggcagacccgagcccggccccagaggcttcgtgccccagaaggagatcgtgtacaacaagctgctgccctacgccgagagactggacgccgagagcgacctgcagctggcccagatcaagtgcaacctgggcagagccgtgcagctgcaggagctgtggcccggcggcctgttctggaccagaaagctgagcacctacatcagactgtacggcagaaagttcagcaaggaggaccacgtgctgttcatcaagctgctgtacgagctggtgagcatccccaagctggagatcagcatgatgcagggcttcgccagactgctgatcaacctgctgaagaagaaggagctgctgagcagagccgacctggagctgccctggagacccctgtacgacatggtggagagaatcctgtacagcaagaccgagcacctgggcctgaactggttccccaacagcgtggagaacatcctgaagaccctggtgaagagctgcagaccctacttccccgccgacgccaccgccgagatgctggaggagtggagacccctgatgtgccccttcgacgtgaccatgcagaaggccatcacctacttcgagatcttcctgcccaccagcctgccccccgagctgcaccacaagggcttcaagctgtggttcgacgagctgatcggcctgtgggtgagcgtgcagaacctgccccagtgggagggccagctggtgaacctgttcgccagactggccaccgacaacatcggctacatcgactgggacccctacgtgcccaagatcttcaccagaatcctgagaagcctgaacctgcccgtgggcagcagccaggtgctggtgcccagattcctgaccaacgcctacgacatcggccacgccgtgatctggatcaccgccatgatgggcggccccagcaagctggtgcagaagcacctggccggcctgttcaacagcatcaccagcttctaccaccccagcaacaacggcagatggctgaacaagctgatgaagctgctgcagagactgcccaacagcgtggtgagaagactgcacagagagagatacaagaagcccagctggctgacccccgtgcccgacagccacaagctgaccgaccaggacgtgaccgacttcgtgcagtgcatcatccagcccgtgctgctggccatgttcagcaagaccggcagcctggaggccgcccaggccctgcagaacctggccctgatgagacccgagctggtgatcccccccgtgctggagagaacctaccccgccctggagaccctgaccgagccccaccagctgaccgccaccctgagctgcgtgatcggcgtggccagaagcctggtgagcggcggcagatggttccccgagggccccacccacatgctgcccctgctgatgagagccctgcccggcgtggaccccaacgacttcagcaagtgcatgatcaccttccagttcatcgccaccttcagcaccctggtgcccctggtggactgcagcagcgtgctgcaggagagaaacgacctgaccgaggtggagagagagctgtgcagcgccaccgccgagttcgaggacttcgtgctgcagttcatggacagatgcttcggcctgatcgagagcagcaccctggagcagaccagagaggagaccgagaccgagaagatgacccacctggagagcctggtggagctgggcctgagcagcaccttcagcaccatcctgacccagtgcagcaaggagatcttcatggtggccctgcagaaggtgttcaacttcagcaccagccacatcttcgagaccagagtggccggcagaatggtggccgacatgtgcagagccgccgtgaagtgctgccccgaggagagcctgaagctgttcgtgccccactgctgcagcgtgatcacccagctgaccatgaacgacgacgtgctgaacgacgaggagctggacaaggagctgctgtggaacctgcagctgctgagcgagatcaccagagtggacggcagaaagctgctgctgtacagagagcagctggtgaagatcctgcagagaaccctgcacctgacctgcaagcagggctacaccctgagctgcaacctgctgcaccacctgctgagaagcaccaccctgatctaccccaccgagtactgcagcgtgcccggcggcttcgacaagccccccagcgagtacttccccatcaaggactggggcaagcccggcgacctgtggaacctgggcatccagtggcacgtgcccagcagcgaggaggtgagcttcgccttctacctgctggacagcttcctgcagcccgagctggtgaagctgcagcactgcggcgacggcaagctggagatgagcagagacgacatcctgcagagcctgaccatcgtgcacaactgcctgatcggcagcggcaacctgctgccccccctgaagggcgagcccgtgaccaacctggtgcccagcatggtgagcctggaggagaccaagctgtacaccggcctggagtacgacctgagcagagagaaccacagagaggtgatcgccaccgtgatcagaaagctgctgaaccacatcctggacaacagcgaggacgacaccaagagcctgttcctgatcatcaagatcatcggcgacctgctgcagttccagggcagccacaagcacgagttcgacagcagatggaagagcttcaacctggtgaagaagagcatggagaacagactgcacggcaagaagcagcacatcagagccctgctgatcgacagagtgatgctgcagcacgagctgagaaccctgaccgtggagggctgcgagtacaagaagatccaccaggacatgatcagagacctgctgagactgagcaccagcagctacagccaggtgagaaacaaggcccagcagaccttcttcgccgccctgggcgcctacaacttctgctgcagagacatcatccccctggtgctggagttcctgagacccgacagacagggcgtgacccagcagcagttcaagggcgccctgtactgcctgctgggcaaccacagcggcgtgtgcctggccaacctgcacgactgggactgcatcgtgcagacctggcccgccatcgtgagcagcggcctgagccaggccatgagcctggagaagcccagcatcgtgagactgttcgacgacctggccgagaagatccacagacagtacgagaccatcggcctggacttcaccatccccaagagctgcgtggagatcgccgagctgctgcagcagagcaagaaccccagcatcaaccagatcctgctgagccccgagaagatcaaggagggcatcaagagacagcaggagaagaacgccgacgccctgagaaactacgagaacctggtggacaccctgctggacggcgtggagcagagaaacctgccctggaagttcgagcacatcggcatcggcctgctgagcctgctgctgagagacgacagagtgctgcccctgagagccatcagattcttcgtggagaacctgaaccacgacgccatcgtggtgagaaagatggccatcagcgccgtggccggcatcctgaagcagctgaagagaacccacaagaagctgaccatcaacccctgcgagatcagcggctgccccaagcccacccagatcatcgccggcgacagacccgacaaccactggctgcactacgacagcaagaccatccccagaaccaagaaggagtgggagagcagctgcttcgtggagaagacccactggggctactacacctggcccaagaacatggtggtgtacgccggcgtggaggagcagcccaagctgggcagaagcagagaggacatgaccgaggccgagcagatcatcttcgaccacttcagcgaccccaagttcgtggagcagctgatcaccttcctgagcctggaggacagaaagggcaaggacaagttcaaccccagaagattctgcctgttcaagggcatcttcagaaacttcgacgacgccttcctgcccgtgctgaagccccacctggagcacctggtggccgacagccacgagagcacccagagatgcgtggccgagatcatcgccggcctgatcagaggcagcaagcactggaccttcgagaaggtggagaagctgtgggagctgctgtgccccctgctgagaaccgccctgagcaacatcaccgtggagacctacaacgactggggcgcctgcatcgccaccagctgcgagagcagagaccccagaaagctgcactggctgttcgagctgctgctggagagccccctgagcggcgagggcggcagcttcgtggacgcctgcagactgtacgtgctgcagggcggcctggcccagcaggagtggagagtgcccgagctgctgcacagactgctgaagtacctggagcccaagctgacccaggtgtacaagaacgtgagagagagaatcggcagcgtgctgacctacatcttcatgatcgacgtgagcctgcccaacaccacccccaccatcagcccccacgtgcccgagttcaccgccagaatcctggagaagctgaagcccctgatggacgtggacgaggagatccagaaccacgtgatggaggagaacggcatcggcgaggaggacgagagaacccagggcatcaagctgctgaagaccatcctgaagtggctgatggccagcgccggcagaagcttcagcaccgccgtgaccgagcagctgcagctgctgcccctgttcttcaagatcgcccccgtggagaacgacaacagctacgacgagctgaagagagacgccaagctgtgcctgagcctgatgagccagggcctgctgtacccccaccaggtgcccctggtgctgcaggtgctgaagcagaccgccagaagcagcagctggcacgccagatacaccgtgctgacctacctgcagaccatggtgttctacaacctgttcatcttcctgaacaacgaggacgccgtgaaggacatcagatggctggtgatcagcctgctggaggacgagcagctggaggtgagagagatggccgccaccaccctgagcggcctgctgcagtgcaacttcctgaccatggacagccccatgcagatccacttcgagcagctgtgcaagaccaagctgcccaagaagagaaagagagaccccggcagcgtgggcgacaccatccccagcgccgagctggtgaagagacacgccggcgtgctgggcctgggcgcctgcgtgctgagcagcccctacgacgtgcccacctggatgccccagctgctgatgaacctgagcgcccacctgaacgacccccagcccatcgagatgaccgtgaagaagaccctgagcaacttcagaagaacccaccacgacaactggcaggagcacaagcagcagttcaccgacgaccagctgctggtgctgaccgacctgctggtgagcccctgctactacgcctag

SEQ ID NO: 94892 - DNA, 2964 bp, Artificial Sequence
  Description of Artificial Sequence: Synthetic coding sequence
atgggcgagaacctggccaagaagatcatgttcttcctgctgaccatcaagctgatcctgaaccacatcctggacaacagcgaggacgacaccaagagcctgttcctgatcatcaagatcatcggcgacctgctgcagttccagggcagccacaagcacgagttcgacagcagatggaagagcttcaacctggtgaagaagagcatggagaacagactgcacggcaagaagcagcacatcagagccctgctgatcgacagagtgatgctgcagcacgagctgagaaccctgaccgtggagggctgcgagtacaagaagatccaccaggacatgatcagagacctgctgagactgagcaccagcagctacagccaggtgagaaacaaggcccagcagaccttcttcgccgccctgggcgcctacaacttctgctgcagagacatcatccccctggtgctggagttcctgagacccgacagacagggcgtgacccagcagcagttcaagggcgccctgtactgcctgctgggcaaccacagcggcgtgtgcctggccaacctgcacgactgggactgcatcgtgcagacctggcccgccatcgtgagcagcggcctgagccaggccatgagcctggagaagcccagcatcgtgagactgttcgacgacctggccgagaagatccacagacagtacgagaccatcggcctggacttcaccatccccaagagctgcgtggagatcgccgagctgctgcagcagagcaagaaccccagcatcaaccagatcctgctgagccccgagaagatcaaggagggcatcaagagacagcaggagaagaacgccgacgccctgagaaactacgagaacctggtggacaccctgctggacggcgtggagcagagaaacctgccctggaagttcgagcacatcggcatcggcctgctgagcctgctgctgagagacgacagagtgctgcccctgagagccatcagattcttcgtggagaacctgaaccacgacgccatcgtggtgagaaagatggccatcagcgccgtggccggcatcctgaagcagctgaagagaacccacaagaagctgaccatcaacccctgcgagatcagcggctgccccaagcccacccagatcatcgccggcgacagacccgacaaccactggctgcactacgacagcaagaccatccccagaaccaagaaggagtgggagagcagctgcttcgtggagaagacccactggggctactacacctggcccaagaacatggtggtgtacgccggcgtggaggagcagcccaagctgggcagaagcagagaggacatgaccgaggccgagcagatcatcttcgaccacttcagcgaccccaagttcgtggagcagctgatcaccttcctgagcctggaggacagaaagggcaaggacaagttcaaccccagaagattctgcctgttcaagggcatcttcagaaacttcgacgacgccttcctgcccgtgctgaagccccacctggagcacctggtggccgacagccacgagagcacccagagatgcgtggccgagatcatcgccggcctgatcagaggcagcaagcactggaccttcgagaaggtggagaagctgtgggagctgctgtgccccctgctgagaaccgccctgagcaacatcaccgtggagacctacaacgactggggcgcctgcatcgccaccagctgcgagagcagagaccccagaaagctgcactggctgttcgagctgctgctggagagccccctgagcggcgagggcggcagcttcgtggacgcctgcagactgtacgtgctgcagggcggcctggcccagcaggagtggagagtgcccgagctgctgcacagactgctgaagtacctggagcccaagctgacccaggtgtacaagaacgtgagagagagaatcggcagcgtgctgacctacatcttcatgatcgacgtgagcctgcccaacaccacccccaccatcagcccccacgtgcccgagttcaccgccagaatcctggagaagctgaagcccctgatggacgtggacgaggagatccagaaccacgtgatggaggagaacggcatcggcgaggaggacgagagaacccagggcatcaagctgctgaagaccatcctgaagtggctgatggccagcgccggcagaagcttcagcaccgccgtgaccgagcagctgcagctgctgcccctgttcttcaagatcgcccccgtggagaacgacaacagctacgacgagctgaagagagacgccaagctgtgcctgagcctgatgagccagggcctgctgtacccccaccaggtgcccctggtgctgcaggtgctgaagcagaccgccagaagcagcagctggcacgccagatacaccgtgctgacctacctgcagaccatggtgttctacaacctgttcatcttcctgaacaacgaggacgccgtgaaggacatcagatggctggtgatcagcctgctggaggacgagcagctggaggtgagagagatggccgccaccaccctgagcggcctgctgcagtgcaacttcctgaccatggacagccccatgcagatccacttcgagcagctgtgcaagaccaagctgcccaagaagagaaagagagaccccggcagcgtgggcgacaccatccccagcgccgagctggtgaagagacacgccggcgtgctgggcctgggcgcctgcgtgctgagcagcccctacgacgtgcccacctggatgccccagctgctgatgaacctgagcgcccacctgaacgacccccagcccatcgagatgaccgtgaagaagaccctgagcaacttcagaagaacccaccacgacaactggcaggagcacaagcagcagttcaccgacgaccagctgctggtgctgaccgacctgctggtgagcccctgctactacgcctag

SEQ ID NO: 94893 - DNA, 867 bp, Artificial Sequence
  Description of Artificial Sequence: Synthetic coding sequence
atggccgccaccttcttcggcgaggtggtgaaggccccctgcagagccggcaccgaggacgaggaggaggaggaggagggcagaagagagacccccgaggacagagaggtgagactgcagctggccagaaagagagaggtgagactgctgagaagacagaccaagaccagcctggaggtgagcctgctggagaagtacccctgcagcaagttcatcatcgccatcggcaacaacgccgtggccttcctgagcagcttcgtgatgaacagcggcgtgtgggaggaggtgggctgcgccaagctgtggaacgagtggtgcagaaccaccgacaccacccacctgagcagcaccgaggccttctgcgtgttctaccacctgaagagcaaccccagcgtgttcctgtgccagtgcagctgctacgtggccgaggaccagcagtaccagtggctggagaaggtgttcggcagctgccccagaaagaacatgcagatcaccatcctgacctgcagacacgtgaccgactacaagaccagcgagagcaccggcagcctgcccagccccttcctgagagccctgaagacccagaacttcaaggacagcgcctgctgccccctgctggagcagcccaacatcgtgcacgacctgcccgccgccgtgctgagctactgccaggtgtggaagatccccgccatcctgtacctgtgctacaccgacgtgatgaagctggacctgatcaccgtggaggccttcaagcccatcctgagcaccagaagcctgaagggcctggtgaagaacatcccccagagcaccgagatcctgaagaagctgatgaccaccaacgagatccagagcaacatctacacctag

SEQ ID NO: 94894 - DNA, 804 bp, Artificial Sequence
  Description of Artificial Sequence: Synthetic coding sequence
atggccgccaccttcttcggcgaggtggtgaaggccccctgcagagccggcaccgaggacgaggaggaggaggaggagggcagaagagagacccccgaggacagagaggtgagactgcagctggccagaaagagagaggtgagactgctgagaagacagaccaagaccagcctggaggtgagcctgctggagaagtacccctgcagcaagttcatcatcgccatcggcaacaacgccgtggccttcctgagcagcttcgtgatgaacagcggcgtgtgggaggaggtgggctgcgccaagctgtggaacgagtggtgcagaaccaccgacaccacccacctgagcagcaccgaggccttctgcgtgttctaccacctgaagagcaaccccagcgtgttcggcagctgccccagaaagaacatgcagatcaccatcctgacctgcagacacgtgaccgactacaagaccagcgagagcaccggcagcctgcccagccccttcctgagagccctgaagacccagaacttcaaggacagcgcctgctgccccctgctggagcagcccaacatcgtgcacgacctgcccgccgccgtgctgagctactgccaggtgtggaagatccccgccatcctgtacctgtgctacaccgacgtgatgaagctggacctgatcaccgtggaggccttcaagcccatcctgagcaccagaagcctgaagggcctggtgaagaacatcccccagagcaccgagatcctgaagaagctgatgaccaccaacgagatccagagcaacatctacacctag

SEQ ID NO: 94895 - DNA, 795 bp, Artificial Sequence
  Description of Artificial Sequence: Synthetic coding sequence
atgttcgtgccctgcggcgagagcgcccccgacctggccggcttcaccctgctgatgcccgccgtgagcgtgggcaacgtgggccagctggccatggacctgatcatcagcaccctgaacatgagcaagatcggctacttctacaccgactgcctggtgcccatggtgggcaacaacccctacgccaccaccgagggcaacagcaccgagctgagcatcaacgccgaggtgtacagcctgcccagcagaaagctggtggccctgcagctgagaagcatcttcatcaagtacaagagcaagcccttctgcgagaagctgctgagctgggtgaagagcagcggctgcgccagagtgatcgtgctgagcagcagccacagctaccagagaaacgacctgcagctgagaagcacccccttcagatacctgctgacccccagcatgcagaagagcgtgcagaacaagatcaagagcctgaactgggaggagatggagaagagcagatgcatccccgagatcgacgacagcgagttctgcatcagaatccccggcggcggcatcaccaagaccctgtacgacgagagctgcagcaaggagatccagatggccgtgctgctgaagttcgtgagcgagggcgacaacatccccgacgccctgggcctggtggagtacctgaacgagtggctgcagatcctgaagcccctgagcgacgaccccaccgtgagcgccagcagatggaagatccccagcagctggagactgctgttcggcagcggcctgccccccgccctgttctag

SEQ ID NO: 94896 - DNA, 459 bp, Artificial Sequence
  Description of Artificial Sequence: Synthetic coding sequence
atgcccgccgtgagcgtgggcaacgtgggccagctggccatggacctgatcatcagcaccctgaacatgagcaagatcggctacttctacaccgactgcctggtgcccatggtgggcaacaacccctacgccaccaccgagggcaacagcaccgagctgagcatcaacgccgaggtgtacagcctgcccagcagaaagctggtggccctgcagctgagaagcatcttcatcaagtacaagagcaagcccttctgcgagaagctgctgagctgggtgaagagcagcggctgcgccagagtgatcgtgctgagcagcagccacagctaccagagaaacgacctgcagctgagaagcacccccttcagatacctgctgacccccagcatgcagaagagcgtgcagaacaagatcaagagcctgaactgggaggagatggagaagggcgccttcctgaagtag

SEQ ID NO: 94897 - DNA, 792 bp, Artificial Sequence
  Description of Artificial Sequence: Synthetic coding sequence
atgttcagaaaccagtacgacaacgacgtgaccgtgtggagcccccagggcagaatccaccagatcgagtacgccatggaggccgtgaagcagggcagcgccaccgtgggcctgaagagcaagacccacgccgtgctggtggccctgaagagagcccagagcgagctggccgcccaccagaagaagatcctgcacgtggacaaccacatcggcatcagcatcgccggcctgaccgccgacgccagactgctgtgcaacttcatgagacaggagtgcctggacagcagattcgtgttcgacagacccctgcccgtgagcagactggtgagcctgatcggcagcaagacccagatccccacccagagatacggcagaagaccctacggcgtgggcctgctgatcgccggctacgacgacatgggcccccacatcttccagacctgccccagcgccaactacttcgactgcagagccatgagcatcggcgccagaagccagagcgccagaacctacctggagagacacatgagcgagttcatggagtgcaacctgaacgagctggtgaagcacggcctgagagccctgagagagaccctgcccgccgagcaggacctgaccaccaagaacgtgagcatcggcatcgtgggcaaggacctggagttcaccatctacgacgacgacgacgtgagccccttcctggagggcctggaggagagaccccagagaaaggcccagcccgcccagcccgccgacgagcccgccgagaaggccgacgagcccatggagcactag

SEQ ID NO: 94898 - DNA, 792 bp, Artificial Sequence; identical to SEQ ID NO: 94897
  Description of Artificial Sequence: Synthetic coding sequence

SEQ ID NO: 94899 - DNA, 810 bp, Artificial Sequence
  Description of Artificial Sequence: Synthetic coding sequence
atgcagctgagcaaggtgaagttcagaaaccagtacgacaacgacgtgaccgtgtggagcccccagggcagaatccaccagatcgagtacgccatggaggccgtgaagcagggcagcgccaccgtgggcctgaagagcaagacccacgccgtgctggtggccctgaagagagcccagagcgagctggccgcccaccagaagaagatcctgcacgtggacaaccacatcggcatcagcatcgccggcctgaccgccgacgccagactgctgtgcaacttcatgagacaggagtgcctggacagcagattcgtgttcgacagacccctgcccgtgagcagactggtgagcctgatcggcagcaagacccagatccccacccagagatacggcagaagaccctacggcgtgggcctgctgatcgccggctacgacgacatgggcccccacatcttccagacctgccccagcgccaactacttcgactgcagagccatgagcatcggcgccagaagccagagcgccagaacctacctggagagacacatgagcgagttcatggagtgcaacctgaacgagctggtgaagcacggcctgagagccctgagagagaccctgcccgccgagcaggacctgaccaccaagaacgtgagcatcggcatcgtgggcaaggacctggagttcaccatctacgacgacgacgacgtgagccccttcctggagggcctggaggagagaccccagagaaaggcccagcccgcccagcccgccgacgagcccgccgagaaggccgacgagcccatggagcactag

SEQ ID NO: 94900 - DNA, 495 bp, Artificial Sequence
  Description of Artificial Sequence: Synthetic coding sequence
atgttcagaaaccagtacgacaacgacgtgaccgtgtggagcccccagggcagaatccaccagatcgagtacgccatggaggccgtgaagcagggcagcgccaccgtgggcctgaagagcaagacccacgccgtgctggtggccctgaagagagcccagagcgagctggccgcccaccagaagaagatcctgcacgtggacaaccacatcggcatcagcatcgccggcctgaccgccgacgccagactgctgtgcaacttcatgagacaggagtgcctggacagcagattcgtgttcgacagacccctgcccgtgagcagactggtgagcctgatcggcagcagcatcctgttcatgatctgggccctgaccttcagcaagcccgtgcacctgctgaccatcctgaccgccgagccctgccccctggagcccgtgcccaaccagctggtgctgacctggagagacatctgcctgaacctgtggagcgtgatctag

SEQ ID NO: 94901 - DNA, 1014 bp, Artificial Sequence
  Description of Artificial Sequence: Synthetic coding sequence
atggaccagaacgagcacagccactggggcccccacgccaagggccagtgcgccagcagaagcgagctgagaatcatcctggtgggcaagaccggcaccggcaagagcgccgccggcaacagcatcctgagaaagcaggccttcgagagcaagctgggcagccagaccctgaccaagacctgcagcaagagccagggcagctggggcaacagagagatcgtgatcatcgacacccccgacatgttcagctggaaggaccactgcgaggccctgtacaaggaggtgcagagatgctacctgctgagcgcccccggcccccacgtgctgctgctggtgacccagctgggcagatacaccagccaggaccagcaggccgcccagagagtgaaggagatcttcggcgaggacgccatgggccacaccatcgtgctgttcacccacaaggaggacctgaacggcggcagcctgatggactacatgcacgacagcgacaacaaggccctgagcaagctggtggccgcctgcggcggcagaatctgcgccttcaacaacagagccgagggcagcaaccaggacgaccaggtgaaggagctgatggactgcatcgaggacctgctgatggagaagaacggcgaccactacaccaacggcctgtacagcctgatccagagaagcaagtgcggccccgtgggcagcgacgagagagtgaaggagttcaagcagagcctgatcaagtacatggagacccagagaagctacaccgccctggccgaggccaactgcctgaagggcgccctgatcaagacccagctgtgcgtgctgttctgcatccagctgttcctgagactgatcatcctgtggctgtgcatcctgcacagcatgtgcaacctgttctgctgcctgctgttcagcatgtgcaacctgttctgcagcctgctgttcatcatccccaagaagctgatgatcttcctgagaaccgtgatcagactggagagaaagacccccagactgtag

SEQ ID NO: 94902 - DNA, 300 bp, Artificial Sequence
  Description of Artificial Sequence: Synthetic coding sequence
atgggccccgactacagagtgctggtgcacagagccagaaagctggcccagcagtactacctggtgtaccaggagcccatccccaccgcccagctggtgcagagagtggccagcgtgatgcaggagtacacccagagcggcggcgtgagacccttcggcgtgagcctgctgatctgcggctggaacgagggcagaccctacctgttccagagcgaccccagcggcgcctacttcgcctggaaggccaccgccatgggcaagaactacgtgaacggcaagaccttcctggagaagagatag

SEQ ID NO: 94903 - DNA, 465 bp, Artificial Sequence
  Description of Artificial Sequence: Synthetic coding sequence
atgctgtactgcgaggccgagagcccccccaccgtggagaaggtgaagcccgccagagagaacagcgagaccgacctggagatcgagggcgagcacggccacctgggcgccgtgagagccgccagcccccagaagctggagaagagcggcttccaggagctgagcagccacagcttccccgagagcgccctgagaatggcctgcggcggcaacgtggccgagagacccgccagattctgcctggagagcagcagcggcctggccggcgagagcagctgcagcttccccagactgagccccgccagcggcgccgtgcccagcagaagactggtgaagagcggcatcaacacccagaccagattcagcaacctgctgaacgtgagcacctggggcatcctgtgcaacctgtgcaacagccccagaagcttccccaagaagggcagcaccgagagagagcacctgtag

SEQ ID NO: 94904 - DNA, 747 bp, Artificial Sequence
  Description of Artificial Sequence: Synthetic coding sequence
atgagcagcatcggcaccggctacgacctgagcgccagcaccttcagccccgacggcagagtgttccaggtggagtacgccatgaaggccgtggagaacagcagcaccgccatcggcatcagatgcaaggacggcgtggtgttcggcgtggagaagctggtgctgagcaagctgtacgaggagggcagcaacaagagactgttcaacgtggacagacacgtgggcatggccgtggccggcctgctggccgacgccagaagcctggccgacatcgccagagaggaggccagcaacttcagaagcaacttcggctacaacatccccctgaagcacctggccgacagagtggccatgtacgtgcacgcctacaccctgtacagcgccgtgagacccttcggctgcagcgtgaacgacggcgcccagctgtacatgatcgaccccagcggcgtgagctacggctactggggctgcgccatcggcaaggccagacaggccgccaagaccgagatcgagaagctgcagatgaaggagatgacctgcagagacatcgtgaaggaggtggccaagatcatctacatcgtgcacgacgaggtgaaggacaaggccttcgagctggagctgagctgggtgggcgagctgaccaacggcagacacgagatcgtgcccaaggacatcagagaggaggccgagaagtacgccaaggagagcctgaaggaggaggacgagagcgacgacgacaacatgtag

SEQ ID NO: 94905 - DNA, 786 bp, Artificial Sequence
  Description of Artificial Sequence: Synthetic coding sequence
atgagcagaagatacgacagcagaaccaccatcttcagccccgagggcagactgtaccaggtggagtacgccatggaggccatcggccacgccggcacctgcctgggcatcctggccaacgacggcgtgctgctggccgccgagagaagaaacatccacaagctgctggacgaggtgttcttcagcgagaagatctacaagctgaacgaggacatggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagaaggtggagatcgccaccctgaccagagagaacggcaagaccgtgatcagagtgctgaagcagaaggaggtggagcagctgatcaagaagcacgaggaggaggaggccaaggccgagagagagaagaaggagaaggagcagaaggagaaggacaagtag

SEQ ID NO: 94906 - DNA, 573 bp, Artificial Sequence
  Description of Artificial Sequence: Synthetic coding sequence
atggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagaaggtggagatcgccaccctgaccagagagaacggcaagaccgtgatcagagtgctgaagcagaaggaggtggagcagctgatcaagaagcacgaggaggaggaggccaaggccgagagagagaagaaggagaaggagcagaaggagaaggacaagtag

SEQ ID NO: 94907 - DNA, 786 bp, Artificial Sequence; identical to SEQ ID NO: 94905
  Description of Artificial Sequence: Synthetic coding sequence

SEQ ID NO: 94908 - DNA, 666 bp, Artificial Sequence
  Description of Artificial Sequence: Synthetic coding sequence
atgagcagaagatacgacagcagaaccaccatcttcagccccgagggcagactgtaccaggtggagtacgccatggaggccatcggccacgccggcacctgcctgggcatcctggccaacgacggcgtgctgctggccgccgagagaagaaacatccacaagctgctggacgaggtgttcttcagcgagaagatctacaagctgaacgaggacatggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagaaggtggagatcgccaccctgaccagagagaacggctag

SEQ ID NO: 94909 - DNA, 630 bp, Artificial Sequence
  Description of Artificial Sequence: Synthetic coding sequence
atgagcagaagatacgacagcagaaccaccatcttcagccccgagggcagactgtaccaggtggagtacgccatggaggccatcggccacgccggcacctgcctgggcatcctggccaacgacggcgtgctgctggccgccgagagaagaaacatccacaagctgctggacgaggtgttcttcagcgagaagatctacaagctgaacgaggacatggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagtag

SEQ ID NO: 94910 - DNA, 693 bp, Artificial Sequence
  Description of Artificial Sequence: Synthetic coding sequence
atgagcagaagatacgacagcagaaccaccatcttcagccccgaggccgagagaagaaacatccacaagctgctggacgaggtgttcttcagcgagaagatctacaagctgaacgaggacatggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagaaggtggagatcgccaccctgaccagagagaacggcaagaccgtgatcagagtgctgaagcagaaggaggtggagcagctgatcaagaagcacgaggaggaggaggccaaggccgagagagagaagaaggagaaggagcagaaggagaaggacaagtag

SEQ ID NO: 94911 - DNA, 711 bp, Artificial Sequence
  Description of Artificial Sequence: Synthetic coding sequence
atgagcagaagatacgacagcagaaccaccatcttcagccccgagggcagactgtaccaggtggagtacgccatggaggccatcggccacgccggcacctgcctgggcatcctggccaacgacggcgtgctgctggccgccgagagaagaaacatccacaagctgctggacgaggtgttcttcagcgagaagatctacaagctgaacgaggacatggcctgcagcgtggccggcatcaccagcgacgccaacgtgctgaccaacgagctgagactgatcgcccagagatacctgctgcagtaccaggagcccatcccctgcgagcagctggtgaccgccctgtgcgacatcaagcaggcctacacccagttcggcggcaagagacccttcggcgtgagcctgctgtacatcggctgggacaagcactacggcttccagctgtaccagagcgaccccagcggcaactacggcggctggaaggccacctgcatcggcaacaacagcgccgccgccgtgagcatgctgaagcaggactacaaggagggcgagatgaccctgaagagcgccctggccctggccatcaaggtgctgaacaagaccatggacgtgagcaagctgagcgccgagaaggtggagatcgccaccctgaccagagagaacggcaagaccgtgatcagagtgctgaagcagaaggaggtggagcagctgtag

SEQ ID NO: 94912 - DNA, 726 bp, Artificial Sequence
  Description of Artificial Sequence: Synthetic coding sequence
atgttcctgaccagaagcgagtacgacagaggcgtgaacaccttcagccccgagggcagactgttccaggtggagtacgccatcgaggccatcaagctgggcagcaccgccatcggcatccagaccagcgagggcgtgtgcctggccgtggagaagagaatcaccagccccctgatggagcccagcagcatcgagaagatcgtggagatcgacgcccacatcggctgcgccatgagcggcctgatcgccgacgccaagaccctgatcgacaaggccagagtggagacccagaaccactggttcacctacaacgagaccatgaccgtggagagcgtgacccaggccgtgagcaacctggccctgcagttcggcgaggaggacgccgaccccggcgccatgagcagacccttcggcgtggccctgctgttcggcggcgtggacgagaagggcccccagctgttccacatggaccccagcggcaccttcgtgcagtgcgacgccagagccatcggcagcgccagcgagggcgcccagagcagcctgcaggaggtgtaccacaagagcatgaccctgaaggaggccatcaagagcagcctgatcatcctgaagcaggtgatggaggagaagctgaacgccaccaacatcgagctggccaccgtgcagcccggccagaacttccacatgttcaccaaggaggagctggaggaggtgatcaaggacatctag

SEQ ID NO: 94913 - DNA, 552 bp, Artificial Sequence
  Description of Artificial Sequence: Synthetic coding sequence
atggagcccagcagcatcgagaagatcgtggagatcgacgcccacatcggctgcgccatgagcggcctgatcgccgacgccaagaccctgatcgacaaggccagagtggagacccagaaccactggttcacctacaacgagaccatgaccgtggagagcgtgacccaggccgtgagcaacctggccctgcagttcggcgaggaggacgccgaccccggcgccatgagcagacccttcggcgtggccctgctgttcggcggcgtggacgagaagggcccccagctgttccacatggaccccagcggcaccttcgtgcagtgcgacgccagagccatcggcagcgccagcgagggcgcccagagcagcctgcaggaggtgtaccacaagagcatgaccctgaaggaggccatcaagagcagcctgatcatcctgaagcaggtgatggaggagaagctgaacgccaccaacatcgagctggccaccgtgcagcccggccagaacttccacatgttcaccaaggaggagctggaggaggtgatcaaggacatctag

SEQ ID NO: 94914 - DNA, 741 bp, Artificial Sequence
  Description of Artificial Sequence: Synthetic coding sequence
atgagcagaggcagcagcgccggcttcgacagacacatcaccatcttcagccccgagggcagactgtaccaggtggagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctgcatgatcctgatcggcatcgacgaggagcagggcccccaggtgtacaagtgcgaccccgccggctactactgcggcttcaaggccaccgccgccggcgtgaagcagaccgagagcaccagcttcctggagaagaaggtgaagaagaagttcgactggaccttcgagcagaccgtggagaccgccatcacctgcctgagcaccgtgctgagcatcgacttcaagcccagcgagatcgaggtgggcgtggtgaccgtggagaaccccaagttcagaatcctgaccgaggccgagatcgacgcccacctggtggccctggccgagagagactag

SEQ ID NO: 94915 - DNA, 684 bp, Artificial Sequence
  Description of Artificial Sequence: Synthetic coding sequence
atggccggcctgagaagagagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctgcatgatcctgatcggcatcgacgaggagcagggcccccaggtgtacaagtgcgaccccgccggctactactgcggcttcaaggccaccgccgccggcgtgaagcagaccgagagcaccagcttcctggagaagaaggtgaagaagaagttcgactggaccttcgagcagaccgtggagaccgccatcacctgcctgagcaccgtgctgagcatcgacttcaagcccagcgagatcgaggtgggcgtggtgaccgtggagaaccccaagttcagaatcctgaccgaggccgagatcgacgcccacctggtggccctggccgagagagactag

SEQ ID NO: 94916 - DNA, 759 bp, Artificial Sequence
  Description of Artificial Sequence: Synthetic coding sequence
atgagcagaggcagcagcgccggcttcgacagacacatcaccatcttcagccccgagggcagactgtaccaggtggagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctggagcttcctgttcctgggcatgatcctgatcggcatcgacgaggagcagggcccccaggtgtacaagtgcgaccccgccggctactactgcggcttcaaggccaccgccgccggcgtgaagcagaccgagagcaccagcttcctggagaagaaggtgaagaagaagttcgactggaccttcgagcagaccgtggagaccgccatcacctgcctgagcaccgtgctgagcatcgacttcaagcccagcgagatcgaggtgggcgtggtgaccgtggagaaccccaagttcagaatcctgaccgaggccgagatcgacgcccacctggtggccctggccgagagagactag

SEQ ID NO: 94917 - DNA, 324 bp, Artificial Sequence
  Description of Artificial Sequence: Synthetic coding sequence
atgagcagaggcagcagcgccggcttcgacagacacatcaccatcttcagccccgagggcagactgtaccaggtggagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgtgagcctgtgcagacccggctgcagcgccagctgggtgcaggccatcctggtgccccagccccccagatag

SEQ ID NO: 94918 - DNA, 447 bp, Artificial Sequence
  Description of Artificial Sequence: Synthetic coding sequence
atgagcagaggcagcagcgccggcttcgacagacacatcaccatcttcagccccgagggcagactgtaccaggtggagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctactgcaactacatgcccgtgtactgcagcatcaactag

SEQ ID NO: 94919 - DNA, 504 bp, Artificial Sequence
  Description of Artificial Sequence: Synthetic coding sequence
atgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctgcatgatcctgatcggcatcgacgaggagcagggcccccaggtgtacaagtgcgaccccgccggctactactgcggcttcaaggccaccgccgccggcgtgaagcagaccgagagcaccagcttcctggagaagaaggtgaagaagaagttcgactggaccttcgagcagaccgtggagaccgccatcacctgcctgagcaccgtgctgagcatcgacttcaagcccagcgagatcgaggtgggcgtggtgaccgtggagaaccccaagttcagaatcctgaccgaggccgagatcgacgcccacctggtggccctggccgagagagactag

SEQ ID NO: 94920 - DNA, 612 bp, Artificial Sequence
  Description of Artificial Sequence: Synthetic coding sequence
atgagcagaggcagcagcgccggcttcgacagacacatcaccatcttcagccccgagggcagactgtaccaggtggagtacgccttcaaggccatcaaccagggcggcctgaccagcgtggccgtgagaggcaaggactgcgccgtgatcgtgacccagaagaaggtgcccgacaagctgctggacagcagcaccgtgacccacctgttcaagatcaccgagaacatcggctgcgtgatgaccggcatgaccgccgacagcagaagccaggtgcagagagccagatacgaggccgccaactggaagtacaagtacggctacgagatccccgtggacatgctgtgcaagagaatcgccgacatcagccaggtgtacacccagaacgccgagatgagacccctgggctgctgcatgatcctgatcggcatcgacgaggagcagggcccccaggtgtacaagtgcgaccccgccggctactactgcggcttcaaggccaccgccgccggcgtgaagcagaccgagagcaccagcttcctggagaagaaggtgaagaagaagttcgactggaccttcgagcagaccgtggaggacagctacagaagcagagactag

SEQ ID NO: 94921 - DNA, 450 bp, Artificial Sequence
  Description of Artificial Sequence: Synthetic coding sequence
atgagctacgacagagccatcaccgtgttcagccccgacggccacctgttccaggtggagtacgcccaggaggccgtgaagaagggcagcaccgccgtgggcgtgagaggcagagacatcgtggtgctgggcgtggagaagaagagcgtggccaagctgcaggacgagagaaccgtgagaaagatctgcgccctggacgacaacgtgtgcatggccttcgccggcctgaccgccgacgccagaatcgtgatcaacagagccagagtggagtgccagagccacagactgaccgtggaggaccccgtgaccgtggagtacatcaccagatacatcgccagcctgaagcaggtgggcgcctgccccctggcctgcagccccctggccgccggccagagcagactgagacacggcggcagctgccacgtgaccagcggcgagagcgagaactag

SEQ ID NO: 94922 - DNA, 537 bp, Artificial Sequence
  Description of Artificial Sequence: Synthetic coding sequence
atggccttcgccggcctgaccgccgacgccagaatcgtgatcaacagagccagagtggagtgccagagccacagactgaccgtggaggaccccgtgaccgtggagtacatcaccagatacatcgccagcctgaagcagagatacacccagagcaacggcagaagacccttcggcatcagcgccctgatcgtgggcttcgacttcgacggcacccccagactgtaccagaccgaccccagcggcacctaccacgcctggaaggccaacgccatcggcagaggcgccaagagcgtgagagagttcctggagaagaactacaccgacgaggccatcgagaccgacgacctgaccatcaagctggtgatcaaggccctgctggaggtggtgcagagcggcggcaagaacatcgagctggccgtgatgagaagagaccagagcctgaagatcctgaaccccgaggagatcgagaagtacgtggccgagatcgagaaggagaaggaggagaacgagaagaagaagcagaagaaggccagctag

SEQ ID NO: 94923 - DNA, 747 bp, Artificial Sequence
  Description of Artificial Sequence: Synthetic coding sequence
atgagctacgacagagccatcaccgtgttcagccccgacggccacctgttccaggtggagtacgcccaggaggccgtgaagaagggcagcaccgccgtgggcgtgagaggcagagacatcgtggtgctgggcgtggagaagaagagcgtggccaagctgcaggacgagagaaccgtgagaaagatctgcgccctggacgacaacgtgtgcatggccttcgccggcctgaccgccgacgccagaatcgtgatcaacagagccagagtggagtgccagagccacagactgaccgtggaggaccccgtgaccgtggagtacatcaccagatacatcgccagcctgaagcagagatacacccagagcaacggcagaagacccttcggcatcagcgccctgatcgtgggcttcgacttcgacggcacccccagactgtaccagaccgaccccagcggcacctaccacgcctggaaggccaacgccatcggcagaggcgccaagagcgtgagagagttcctggagaagaactacaccgacgaggccatcgagaccgacgacctgaccatcaagctggtgatcaaggccctgctggaggtggtgcagagcggcggcaagaacatcgagctggccgtgatgagaagagaccagagcctgaagatcctgaaccccgaggagatcgagaagtacgtggccgagatcgagaaggagaaggaggagaacgagaagaagaagcagaagaaggccagctag

SEQ ID NO: 94924 - DNA, 564 bp, Artificial Sequence
  Description of Artificial Sequence: Synthetic coding sequence
tgactgaccgccgacgccagaatcgtgatcaacagagccagagtggagtgccagagccacagactgaccgtggaggaccccgtgaccgtggagtacatcaccagatacatcgccagcctgaagcagagatacacccagagcaacggcagaagacccttcggcatcagcgccctgatcgtgggcttcgacttcgacggcacccccagactgtaccagaccgaccccagcggcacctaccacgcctggaaggccaacgccatcggcagaggcgccaagagcgtgagagagttcctggagaagaactacaccgacgaggccatcgagaccgacgacctgaccatcaagctggtgatcaaggccctgctggagggcaaggtggtgaacgcccccgtgttctgccccttcaaggtggtgcagagcggcggcaagaacatcgagctggccgtgatgagaagagaccagagcctgaagatcctgaaccccgaggagatcgagaagtacgtggccgagatcgagaaggagaaggaggagaacgagaagaagaagcagaagaaggccagctag

SEQ ID NO: 94925 - DNA, 726 bp, Artificial Sequence
  Description of Artificial Sequence: Synthetic coding sequence
atgctgagcagcaccgccatgtacagcgcccccggcagagacctgggcatggagccccacagagccgccggccccctgcagctgagattcagcccctacgtgttcaacggcggcaccatcctggccatcgccggcgaggacttcgccatcgtggccagcgacaccagactgagcgagggcttcagcatccacaccagagacagccccaagtgctacaagctgaccgacaagaccgtgatcggctgcagcggcttccacggcgactgcctgaccctgaccaagatcatcgaggccagactgaagatgtacaagcacagcaacaacaaggccatgaccaccggcgccatcgccgccatgctgagcaccatcctgtacagcagaagattcttcccctactacgtgtacaacatcatcggcggcctggacgaggagggcaagggcgccgtgtacagcttcgaccccgtgggcagctaccagagagacagcttcaaggccggcggcagcgccagcgccatgctgcagcccctgctggacaaccaggtgggcttcaagaacatgcagaacgtggagcacgtgcccctgagcctggacagagccatgagactggtgaaggacgtgttcatcagcgccgccgagagagacgtgtacaccggcgacgccctgagaatctgcatcgtgaccaaggagggcatcagagaggagaccgtgagcctgagaaaggactag

SEQ ID NO: 94926 - DNA, 591 bp, Artificial Sequence
  Description of Artificial Sequence: Synthetic coding sequence
agaagaagcagagccatgctgagcagcaccgccatgtacagcgcccccggcagagacctgggcatggagccccacagagccgccggccccctgcagctgagattcagcccctacgtgttcaacggcggcaccatcctggccatcgccggcgaggacttcgccatcgtggccagcgacaccagactgagcgagggcttcagcatccacaccagagacagccccaagtgctacaagctgaccgacaagaccgtgatcggctgcagcggcttccacggcgactgcctgaccctgaccaagatcatcgaggccagactgaagatgtacaagcacagcaacaacaaggccatgaccaccggcgccatcgccgccatgctgagcaccatcctgtacagcagaagattcttcccctactacgtgtacaacatcatcggcggcctggacgaggagggcaagggcgccgtgtacagcttcgaccccgtgggcagctaccagagagacagcttcaaggccggcggcagcgccagcgccatgctgcagcccctgctggacaaccagtacatcagcagcaacagcgtgagcctgtgcgtgtag

SEQ ID NO: 94927 - DNA, 822 bp, Artificial Sequence
  Description of Artificial Sequence: Synthetic coding sequence
atgctgaagcccgccctggagcccagaggcggcttcagcttcgagaactgccagagaaacgccagcctggagagagtgctgcccggcctgaaggtgccccacgccagaaagaccggcaccaccatcgccggcctggtgttccaggacggcgtgatcctgggcgccgacaccagagccaccaacgacagcgtggtggccgacaagagctgcgagaagatccacttcatcgcccccaagatctactgctgcggcgccggcgtggccgccgacgccgagatgaccaccagaatggtggccagcaagatggagctgcacgccctgagcaccggcagagagcccagagtggccaccgtgaccagaatcctgagacagaccctgttcagataccagggccacgtgggcgccagcctgatcgtgggcggcgtggacctgaccggcccccagctgtacggcgtgcacccccacggcagctacagcagactgcccttcaccgccctgggcagcggccaggacgccgccctggccgtgctggaggacagattccagcccaacatgaccctggaggccgcccagggcctgctggtggaggccgtgaccgccggcatcctgggcgacctgggcagcggcggcaacgtggacgcctgcgtgatcaccaagaccggcgccaagctgctgagaaccctgagcagccccaccgagcccgtgaagagaagcggcagataccacttcgtgcccggcaccaccgccgtgctgacccagaccgtgaagcccctgaccctggagctggtggaggagaccgtgcaggccatggaggtggagtag

SEQ ID NO: 94928 - DNA, 903 bp, Artificial Sequence
  Description of Artificial Sequence: Synthetic coding sequence
atggccctgcaggacgtgtgcaagtggcagagccccgacacccagggccccagcccccacctgcccagagccggcggctgggccgtgcccagaggctgcgacccccagaccttcctgcagatccacggccccagactggcccacggcaccaccaccctggccttcagattcagacacggcgtgatcgccgccgccgacaccagaagcagctgcggcagctacgtggcctgccccgccagctgcaaggtgatccccgtgcaccagcacctgctgggcaccaccagcggcaccagcgccgactgcgccacctggtacagagtgctgcagagagagctgagactgagagagctgagagagggccagctgcccagcgtggccagcgccgccaagctgctgagcgccatgatgagccagtacagaggcctggacctgtgcgtggccaccgccctgtgcggctgggacagaagcggccccgagctgttctacgtgtacagcgacggcaccagactgcagggcgacatcttcagcgtgggcagcggcagcccctacgcctacggcgtgctggacagaggctacagatacgacatgagcacccaggaggcctacgccctggccagatgcgccgtggcccacgccacccacagagacgcctacagcggcggcagcgtggacctgttccacgtgagagagagcggctgggagcacgtgagcagaagcgacgcctgcgtgctgtacgtggagctgcagaagctgctggagcccgagcccgaggaggacgccagccacgcccaccccgagcccgccaccgcccacagagccgccgaggacagagagctgagcgtgggccccggcgaggtgacccccggcgacagcagaatgcccgccggcaccgagaccgtgtag

SEQ ID NO: 94929 - DNA, 606 bp, Artificial Sequence
  Description of Artificial Sequence: Synthetic coding sequence
atggagtacctgatcggcatccagggccccgactacgtgctggtggccagcgacagagtggccgccagcaacatcgtgcagatgaaggacgaccacgacaagatgttcaagatgagcgagaagatcctgctgctgtgcgtgggcgaggccggcgacaccgtgcagttcgccgagtacatccagaagaacgtgcagctgtacaagatgagaaacggctacgagctgagccccaccgccgccgccaacttcaccagaagaaacctggccgactgcctgagaagcagaaccccctaccacgtgaacctgctgctggccggctacgacgagcacgagggccccgccctgtactacatggactacctggccgccctggccaaggcccccttcgccgcccacggctacggcgccttcctgaccctgagcatcctggacagatactacacccccaccatcagcagagagagagccgtggagctgctgagaaagtgcctggaggagctgcagaagagattcatcctgaacctgcccaccttcagcgtgagaatcatcgacaagaacggcatccacgacctggacaacatcagcttccccaagcagggcagctag

SEQ ID NO: 94930 - DNA, 468 bp, Artificial Sequence
  Description of Artificial Sequence: Synthetic coding sequence
atggccagcctgaagtgcagcaccgtggtgtgcgtgatctgcctggagaagcccaagtacagatgccccgcctgcagagtgccctactgcagcgtggtgtgcttcagaaagcacaaggagcagtgcaaccccgagaccagacccgtggagaagaagatcagaagcgccctgcccaccaagaccgtgaagcccgtggagaacaaggacgacgacgacagcatcgccgacttcctgaacagcgacgaggaggaggacagagtgagcctgcagaacctgaagaacctgggcgagagcgccaccctgagaagcctgctgctgaacccccacctgagacagctgatggtgaacctggaccagggcgaggacaaggccaagctgatgagagcctacatgcaggagcccctgttcgtggagttcgccgactgctgcctgggcatcgtggagcccagccagaacgaggagagctag

SEQ ID NO: 94931 - DNA, 795 bp, Artificial Sequence
  Description of Artificial Sequence: Synthetic coding sequence
atggaggccttcctgggcagcagaagcggcctgtgggccggcggccccgcccccggccagttctacagaatccccagcacccccgacagcttcatggaccccgccagcgccctgtacagaggccccatcaccagaacccagaaccccatggtgaccggcaccagcgtgctgggcgtgaagttcgagggcggcgtggtgatcgccgccgacatgctgggcagctacggcagcctggccagattcagaaacatcagcagaatcatgagagtgaacaacagcaccatgctgggcgccagcggcgactacgccgacttccagtacctgaagcaggtgctgggccagatggtgatcgacgaggagctgctgggcgacggccacagctacagccccagagccatccacagctggctgaccagagccatgtacagcagaagaagcaagatgaaccccctgtggaacaccatggtgatcggcggctacgccgacggcgagagcttcctgggctacgtggacatgctgggcgtggcctacgaggcccccagcctggccaccggctacggcgcctacctggcccagcccctgctgagagaggtgctggagaagcagcccgtgctgagccagaccgaggccagagacctggtggagagatgcatgagagtgctgtactacagagacgccagaagctacaacagattccagatcgccaccgtgaccgagaagggcgtggagatcgagggccccctgagcaccgagaccaactgggacatcgcccacatgatcagcggcttcgagtag

SEQ ID NO: 94932 - DNA, 792 bp, Artificial Sequence
  Description of Artificial Sequence: Synthetic coding sequence
atggccctggccagcgtgctggagagacccctgcccgtgaaccagagaggcttcttcggcctgggcggcagagccgacctgctggacctgggccccggcagcctgagcgacggcctgagcctggccgcccccggctggggcgtgcccgaggagcccggcatcgagatgctgcacggcaccaccaccctggccttcaagttcagacacggcgtgatcgtggccgccgacagcagagccaccgccggcgcctacatcgccagccagaccgtgaagaaggtgatcgagatcaacccctacctgctgggcaccatggccggcggcgccgccgactgcagcttctgggagagactgctggccagacagtgcagaatctacgagctgagaaacaaggagagaatcagcgtggccgccgccagcaagctgctggccaacatggtgtaccagtacaagggcatgggcctgagcatgggcaccatgatctgcggctgggacaagagaggccccggcctgtactacgtggacagcgagggcaacagaatcagcggcgccaccttcagcgtgggcagcggcagcgtgtacgcctacggcgtgatggacagaggctacagctacgacctggaggtggagcaggcctacgacctggccagaagagccatctaccaggccacctacagagacgcctacagcggcggcgccgtgaacctgtaccacgtgagagaggacggctggatcagagtgagcagcgacaacgtggccgacctgcacgagaagtacagcggcagcaccccctag

SEQ ID NO: 94933 - DNA, 483 bp, Artificial Sequence
  Description of Artificial Sequence: Synthetic coding sequence
atggccggcggcgccgccgactgcagcttctgggagagactgctggccagacagtgcagaatctacgagctgagaaacaaggagagaatcagcgtggccgccgccagcaagctgctggccaacatggtgtaccagtacaagggcatgggcctgagcatgggcaccatgatctgcggctgggacaagagaggccccggcctgtactacgtggacagcgagggcaacagaatcagcggcgccaccttcagcgtgggcagcggcagcgtgtacgcctacggcgtgatggacagaggctacagctacgacctggaggtggagcaggcctacgacctggccagaagagccatctaccaggccacctacagagacgcctacagcggcggcgccgtgaacctgtaccacgtgagagaggacggctggatcagagtgagcagcgacaacgtggccgacctgcacgagaagtacagcggcagcaccccctag

SEQ ID NO: 94934 - DNA, 612 bp, Artificial Sequence
  Description of Artificial Sequence: Synthetic coding sequence
atggccctggccagcgtgctggagagacccctgcccgtgaaccagagaggcttcttcggcctgggcggcagagccgacctgctggacctgggccccggcagcctgagcgacggcctgagcctggccgcccccggctggggcgtgcccgaggagcccggcatcgagatgctgcacggcaccaccaccctggccttcaagttcagacacggcgtgatcgtggccgccgacagcagagccaccgccggcgcctacatcgccagccagaccgtgaagaaggtgatcgagatcaacccctacctgctgggcaccatggccggcggcgccgccgactgcagcttctgggagagactgctggccagacagtgcagaatctacgagctgagaaacaaggagagaatcagcgtggccgccgccagcaagctgctggccaacatggtgtaccagtacaagggcatgggcctgagcatgggcaccatgatctgcggctgggacaagagaggccccgtgagcgaggtgctgtgcctgaagcccaagagcttcggcatgtacctgttctgcggctgcgccgagagaatcggcaacatggccagacccctgctgagaggccagtag

SEQ ID NO: 94935 - DNA, 834 bp, Artificial Sequence
  Description of Artificial Sequence: Synthetic coding sequence
atggccgccgtgagcgtgtacgccccccccgtgggcggcttcagcttcgacaactgcagaagaaacgccgtgctggaggccgacttcgccaagagaggctacaagctgcccaaggtgagaaagaccggcaccaccatcgccggcgtggtgtacaaggacggcatcgtgctgggcgccgacaccagagccaccgagggcatggtggtggccgacaagaactgcagcaagatccacttcatcagccccaacatctactgctgcggcgccggcaccgccgccgacaccgacatgaccacccagctgatcagcagcaacctggagctgcacagcctgagcaccggcagactgcccagagtggtgaccgccaacagaatgctgaagcagatgctgttcagataccagggctacatcggcgccgccctggtgctgggcggcgtggacgtgaccggcccccacctgtacagcatctacccccacggcagcaccgacaagctgccctacgtgaccatgggcagcggcagcctggccgccatggccgtgttcgaggacaagttcagacccgacatggaggaggaggaggccaagaacctggtgagcgaggccatcgccgccggcatcttcaacgacctgggcagcggcagcaacatcgacctgtgcgtgatcagcaagaacaagctggacttcctgagaccctacaccgtgcccaacaagaagggcaccagactgggcagatacagatgcgagaagggcaccaccgccgtgctgaccgagaagatcacccccctggagatcgaggtgctggaggagaccgtgcagaccatggacaccagctag

SEQ ID NO: 94936 - DNA, 633 bp, Artificial Sequence
  Description of Artificial Sequence: Synthetic coding sequence
atggccgccgtgagcgtgtacgccccccccgtgggcggcttcagcttcgacaactgcagaagaaacgccgtgctggaggccgacttcgccaagagaggctacaagctgcccaaggtgagaaagaccggcaccaccatcgccggcgtggtgtacaaggacggcatcgtgctgggcgccgacaccagagccaccgagggcatggtggtggccgacaagaactgcagcaagatccacttcatcagccccaacatctactgctgcggcgccggcaccgccgccgacaccgacatgaccacccagctgatcagcagcaacctggagctgcacagcctgagcaccggcagactgcccagagtggtgaccgccaacagaatgctgaagcagatgctgttcagataccagggctacatcggcgccgccctggtgctgggcggcgtggacgtgaccggcccccacctgtacagcatctacccccacggcagcaccgacaagctgccctacgtgaccatggtgcactgcgaggaggagctgttcaccgagaacctgttcttcatcagacaggccgaggtggtgagcgaggaggcctggggccccagcttcgccatcagcctggccgtgttcctggtggcctag

SEQ ID NO: 94937 - DNA, 429 bp, Artificial Sequence
  Description of Artificial Sequence: Synthetic coding sequence
atggccgccgtgagcgtgtacgccccccccgtgggcggcttcagcttcgacaactgcagaagaaacgccgtgctggaggccgacttcgccaagagaggctacaagctgcccaaggtgagaaagaccggcaccaccatcgccggcgtggtgtacaaggacggcatcgtgctgggcgccgacaccagagccaccgagggcatggtggtggccgacaagaactgcagcaagatccacttcatcagccccaacatctactgctgcggcgccggcaccgccgccgacaccgacatgaccacccagctgatcagcagcaacctggagctgcacagcctgagcaccggcagactgcccagagtggtgaccgccaacagaatgctgaagcagatgctgttcagattctggctgctgggcagcaacggctgcatctag

SEQ ID NO: 94938 - DNA, 819 bp, Artificial Sequence
  Description of Artificial Sequence: Synthetic coding sequence
atgctgatcggcacccccacccccagagacaccacccccagcagctggctgaccagcagcctgctggtggaggccgcccccctggacgacaccaccctgcccacccccgtgagcagcggctgccccggcctggagcccaccgagttcttccagagcctgggcggcgacggcgagagaaacgtgcagatcgagatggcccacggcaccaccaccctggccttcaagttccagcacggcgtgatcgccgccgtggacagcagagccagcgccggcagctacatcagcgccctgagagtgaacaaggtgatcgagatcaacccctacctgctgggcaccatgagcggctgcgccgccgactgccagtactgggagagactgctggccaaggagtgcagactgtactacctgagaaacggcgagagaatcagcgtgagcgccgccagcaagctgctgagcaacatgatgtgccagtacagaggcatgggcctgagcatgggcagcatgatctgcggctgggacaagaagggccccggcctgtactacgtggacgagcacggcaccagactgagcggcaacatgttcagcaccggcagcggcaacacctacgcctacggcgtgatggacagcggctacagacccaacctgagccccgaggaggcctacgacctgggcagaagagccatcgcctacgccacccacagagacagctacagcggcggcgtggtgaacatgtaccacatgaaggaggacggctgggtgaaggtggagagcaccgacgtgagcgacctgctgcaccagtacagagaggccaaccagtag

SEQ ID NO: 94939 - DNA, 831 bp, Artificial Sequence
  Description of Artificial Sequence: Synthetic coding sequence
atggccctgctggacgtgtgcggcgcccccagaggccagagacccgagagcgccctgcccgtggccggcagcggcagaagaagcgaccccggccactacagcttcagcatgagaagccccgagctggccctgcccagaggcatgcagcccaccgagttcttccagagcctgggcggcgacggcgagagaaacgtgcagatcgagatggcccacggcaccaccaccctggccttcaagttccagcacggcgtgatcgccgccgtggacagcagagccagcgccggcagctacatcagcgccctgagagtgaacaaggtgatcgagatcaacccctacctgctgggcaccatgagcggctgcgccgccgactgccagtactgggagagactgctggccaaggagtgcagactgtactacctgagaaacggcgagagaatcagcgtgagcgccgccagcaagctgctgagcaacatgatgtgccagtacagaggcatgggcctgagcatgggcagcatgatctgcggctgggacaagaagggccccggcctgtactacgtggacgagcacggcaccagactgagcggcaacatgttcagcaccggcagcggcaacacctacgcctacggcgtgatggacagcggctacagacccaacctgagccccgaggaggcctacgacctgggcagaagagccatcgcctacgccacccacagagacagctacagcggcggcgtggtgaacatgtaccacatgaaggaggacggctgggtgaaggtggagagcaccgacgtgagcgacctgctgcaccagtacagagaggccaaccagtag

SEQ ID NO: 94940 - DNA, 831 bp, Artificial Sequence; identical to SEQ ID NO: 94939
  Description of Artificial Sequence: Synthetic coding sequence

SEQ ID NO: 94941 - DNA, 819 bp, Artificial Sequence; identical to SEQ ID NO: 94938
  Description of Artificial Sequence: Synthetic coding sequence

SEQ ID NO: 94942 - DNA, 759 bp, Artificial Sequence
  Description of Artificial Sequence: Synthetic coding sequence
atggccctgctggacgtgtgcggcgcccccagaggccagagacccgagagcgccctgcccgtggccggcagcggcagaagaagcgaccccggccactacagcttcagcatgagaagccccgagctggccctgcccagaggcatgcagcccaccgagttcttccagagcctgggcggcgacggcgagagaaacgtgcagatcgagatggcccacggcaccaccaccctggccttcaagttccagcacggcgtgatcgccgccgtggacagcagagccagcgccggcagctacatcaactgccagtactgggagagactgctggccaaggagtgcagactgtactacctgagaaacggcgagagaatcagcgtgagcgccgccagcaagctgctgagcaacatgatgtgccagtacagaggcatgggcctgagcatgggcagcatgatctgcggctgggacaagaagggccccggcctgtactacgtggacgagcacggcaccagactgagcggcaacatgttcagcaccggcagcggcaacacctacgcctacggcgtgatggacagcggctacagacccaacctgagccccgaggaggcctacgacctgggcagaagagccatcgcctacgccacccacagagacagctacagcggcggcgtggtgaacatgtaccacatgaaggaggacggctgggtgaaggtggagagcaccgacgtgagcgacctgctgcaccagtacagagaggccaaccagtag

SEQ ID NO: 94943 - DNA, 759 bp, Artificial Sequence; identical to SEQ ID NO: 94942
  Description of Artificial Sequence: Synthetic coding sequence

SEQ ID NO: 94944 - DNA, 819 bp, Artificial Sequence; identical to SEQ ID NO: 94938
  Description of Artificial Sequence: Synthetic coding sequence

SEQ ID NO: 94945 - DNA, 819 bp, Artificial Sequence; identical to SEQ ID NO: 94938
  Description of Artificial Sequence: Synthetic coding sequence

SEQ ID NO: 94946 - DNA, 831 bp, Artificial Sequence; identical to SEQ ID NO: 94939
  Description of Artificial Sequence: Synthetic coding sequence

SEQ ID NO: 94947 - DNA, 759 bp, Artificial Sequence; identical to SEQ ID NO: 94942
  Description of Artificial Sequence: Synthetic coding sequence

SEQ ID NO: 94948 - DNA, 759 bp, Artificial Sequence; identical to SEQ ID NO: 94942
  Description of Artificial Sequence: Synthetic coding sequence

SEQ ID NO: 94949 - DNA, 831 bp, Artificial Sequence; identical to SEQ ID NO: 94939
  Description of Artificial Sequence: Synthetic coding sequence

SEQ ID NO: 94950 - DNA, 819 bp, Artificial Sequence; identical to SEQ ID NO: 94938
  Description of Artificial Sequence: Synthetic coding sequence

SEQ ID NO: 94951 - DNA, 819 bp, Artificial Sequence; identical to SEQ ID NO: 94938
  Description of Artificial Sequence: Synthetic coding sequence

SEQ ID NO: 94952 - DNA, 831 bp, Artificial Sequence; identical to SEQ ID NO: 94939
  Description of Artificial Sequence: Synthetic coding sequence

SEQ ID NO: 94953 - DNA, 819 bp, Artificial Sequence; identical to SEQ ID NO: 94938
  Description of Artificial Sequence: Synthetic coding sequence

SEQ ID NO: 94954 - DNA, 831 bp, Artificial Sequence
  Description of Artificial Sequence: Synthetic coding sequence
atggccctgctggacgtgtgcggcgcccccagaggccagagacccgagagcgccctgcccgtggccggcagcggcagaagaagcgaccccggccactacagcttcagcatgagaagccccgagctggccctgcccagaggcatgaagcccaccgagttcttccagagcctgggcggcgacggcgagagaaacgtgcagatcgagatggcccacggcaccaccaccctggccttcaagttccagcacggcgtgatcgccgccgtggacagcagagccagcgccggcagctacatcagcgccctgagagtgaacaaggtgatcgagatcaacccctacctgctgggcaccatgagcggctgcgccgccgactgccagtactgggagagactgctggccaaggagtgcagactgtactacctgagaaacggcgagagaatcagcgtgagcgccgccagcaagctgctgagcaacatgatgtgccagtacagaggcatgggcctgagcatgggcagcatgatctgcggctgggacaagaagggccccggcctgtactacgtggacgagcacggcaccagactgagcggcaacatgttcagcaccggcagcggcaacacctacgcctacggcgtgatggacagcggctacagacccaacctgagccccgaggaggcctacgacctgggcagaagagccatcgcctacgccacccacagagacagctacagcggcggcgtggtgaacatgtaccacatgaaggaggacggctgggtgaaggtggagagcaccgacgtgagcgacctgctgcaccagtacagagaggccaaccagtag

SEQ ID NO: 94955 - DNA, 759 bp, Artificial Sequence; identical to SEQ ID NO: 94942
  Description of Artificial Sequence: Synthetic coding sequence

SEQ ID NO: 94956 - DNA, 759 bp, Artificial Sequence; identical to SEQ ID NO: 94942
  Description of Artificial Sequence: Synthetic coding sequence

SEQ ID NO: 94957 - DNA, 759 bp, Artificial Sequence
  Description of Artificial Sequence: Synthetic coding sequence
atggccctgctggacgtgtgcggcgcccccagaggccagagacccgagagcgccctgcccgtggccggcagcggcagaagaagcgaccccggccactacagcttcagcatgagaagccccgagctggccctgcccagaggcatgaagcccaccgagttcttccagagcctgggcggcgacggcgagagaaacgtgcagatcgagatggcccacggcaccaccaccctggccttcaagttccagcacggcgtgatcgccgccgtggacagcagagccagcgccggcagctacatcaactgccagtactgggagagactgctggccaaggagtgcagactgtactacctgagaaacggcgagagaatcagcgtgagcgccgccagcaagctgctgagcaacatgatgtgccagtacagaggcatgggcctgagcatgggcagcatgatctgcggctgggacaagaagggccccggcctgtactacgtggacgagcacggcaccagactgagcggcaacatgttcagcaccggcagcggcaacacctacgcctacggcgtgatggacagcggctacagacccaacctgagccccgaggaggcctacgacctgggcagaagagccatcgcctacgccacccacagagacagctacagcggcggcgtggtgaacatgtaccacatgaaggaggacggctgggtgaaggtggagagcaccgacgtgagcgacctgctgcaccagtacagagaggccaaccagtag

SEQ ID NO: 94958 - DNA, 819 bp, Artificial Sequence; identical to SEQ ID NO: 94938
  Description of Artificial Sequence: Synthetic coding sequence

SEQ ID NO: 94959 - DNA, 831 bp, Artificial Sequence; identical to SEQ ID NO: 94939
  Description of Artificial Sequence: Synthetic coding sequence

SEQ ID NO: 94960 - DNA, 831 bp, Artificial Sequence; identical to SEQ ID NO: 94939
  Description of Artificial Sequence: Synthetic coding sequence

SEQ ID NO: 94961 - DNA, 759 bp, Artificial Sequence; identical to SEQ ID NO: 94942
  Description of Artificial Sequence: Synthetic coding sequence

SEQ ID NO: 94962 - DNA, 831 bp, Artificial Sequence; identical to SEQ ID NO: 94939
  Description of Artificial Sequence: Synthetic coding sequence

SEQ ID NO: 94963 - DNA, 660 bp, Artificial Sequence
  Description of Artificial Sequence: Synthetic coding sequence
atgctgagagccggcgcccccaccggcgacctgcccagagccggcgaggtgcacaccggcaccaccatcatggccgtggagttcgacggcggcgtggtgatgggcagcgacagcagagtgagcgccggcgaggccgtggtgaacagagtgttcgacaagctgagccccctgcacgagagaatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccatcgccctggccatgagcagagacggcagcagcggcggcgtgatctacctggtgaccatcaccgccgccggcgtggaccacagagtgatcctgggcaacgagctgcccaagttctacgacgagtag

SEQ ID NO: 94964 - DNA, 660 bp, Artificial Sequence; identical to SEQ ID NO: 94963
  Description of Artificial Sequence: Synthetic coding sequence

SEQ ID NO: 94965 - DNA, 660 bp, Artificial Sequence; identical to SEQ ID NO: 94963
  Description of Artificial Sequence: Synthetic coding sequence

SEQ ID NO: 94966 - DNA, 591 bp, Artificial Sequence
  Description of Artificial Sequence: Synthetic coding sequence
atggccgtggagttcgacggcggcgtggtgatgggcagcgacagcagagtgagcgccggcgaggccgtggtgaacagagtgttcgacaagctgagccccctgcacgagagaatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccatcgccctggccatgagcagagacggcagcagcggcggcgtgatctacctggtgaccatcaccgccgccggcgtggaccacagagtgatcctgggcaacgagctgcccaagttctacgacgagtag

SEQ ID NO: 94967 - DNA, 537 bp, Artificial Sequence
  Description of Artificial Sequence: Synthetic coding sequence
atgctgagagccggcgcccccaccggcgacctgcccagagccggcgaggtgcacaccggcaccaccatcatggccgtggagttcgacggcggcgtggtgatgggcagcgacagcagagtgagcgccggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccaccagcaccaagagaagagtgtgcggctacttcctgagaacccagaagagagagaaccagaaccagagagtgcacgagtacatgtgcaccggcgagagaagcctgagcagcagccccctgctgagctgcagctag

SEQ ID NO: 94968 - DNA, 591 bp, Artificial Sequence; identical to SEQ ID NO: 94966
  Description of Artificial Sequence: Synthetic coding sequence

SEQ ID NO: 94969 - DNA, 537 bp, Artificial Sequence; identical to SEQ ID NO: 94967
  Description of Artificial Sequence: Synthetic coding sequence

SEQ ID NO: 94970 - DNA, 591 bp, Artificial Sequence; identical to SEQ ID NO: 94966
  Description of Artificial Sequence: Synthetic coding sequence

SEQ ID NO: 94971 - DNA, 537 bp, Artificial Sequence; identical to SEQ ID NO: 94967
  Description of Artificial Sequence: Synthetic coding sequence

SEQ ID NO: 94972 - DNA, 396 bp, Artificial Sequence
  Description of Artificial Sequence: Synthetic coding sequence
atggccgtggagttcgacggcggcgtggtgatgggcagcgacagcagagtgagcgccggcgaggccgtggtgaacagagtgttcgacaagctgagccccctgcacgagagaatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctag

SEQ ID NO: 94973 - DNA, 396 bp, Artificial Sequence; identical to SEQ ID NO: 94972
  Description of Artificial Sequence: Synthetic coding sequence

SEQ ID NO: 94974 - DNA, 396 bp, Artificial Sequence; identical to SEQ ID NO: 94972
  Description of Artificial Sequence: Synthetic coding sequence

SEQ ID NO: 94975 - DNA, 396 bp, Artificial Sequence; identical to SEQ ID NO: 94972
  Description of Artificial Sequence: Synthetic coding sequence

SEQ ID NO: 94976 - DNA, 537 bp, Artificial Sequence
  Description of Artificial Sequence: Synthetic coding sequence
atgctgagagccggcgcccccaccggcgacctgcccagagccggcgaggtgcacaccggcaccaccatcatggccgtggagttcgacggcggcgtggtgatgggcagcgacagcagagtgagcgccggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccaccagcaccaagagaagagtgtgcggctacttcctgagaacccagaagagagagaaccagaaccagagagtgcacgagtacatgtgcaccagcgagagaagcctgagcagcagccccctgctgagctgcagctag

SEQ ID NO: 94977 - DNA, 396 bp, Artificial Sequence
  Description of Artificial Sequence: Synthetic coding sequence
atggccgtggagttcgacggcggcgtggtgatgggcagcgacagcagagtgagcgccggcgaggccgtggtgaacagagtgttcgacaagctgagccccctgcacgagcacatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctag

SEQ ID NO: 94978 - DNA, 591 bp, Artificial Sequence; identical to SEQ ID NO: 94966
  Description of Artificial Sequence: Synthetic coding sequence

SEQ ID NO: 94979 - DNA, 660 bp, Artificial Sequence; identical to SEQ ID NO: 94963
  Description of Artificial Sequence: Synthetic coding sequence

SEQ ID NO: 94980 - DNA, 591 bp, Artificial Sequence
  Description of Artificial Sequence: Synthetic coding sequence
atggccgtggagttcgacggcggcgtggtgatgggcagcgacagcagagtgagcgccggcgaggccgtggtgaacagagtgttcgacaagctgagccccctgcacgagcacatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccatcgccctggccatgagcagagacggcagcagcggcggcgtgatctacctggtgaccatcaccgccgccggcgtggaccacagagtgatcctgggcaacgagctgcccaagttctacgacgagtag

SEQ ID NO: 94981 - DNA, 537 bp, Artificial Sequence; identical to SEQ ID NO: 94976
  Description of Artificial Sequence: Synthetic coding sequence

SEQ ID NO: 94982 - DNA, 537 bp, Artificial Sequence; identical to SEQ ID NO: 94976
  Description of Artificial Sequence: Synthetic coding sequence

SEQ ID NO: 94983 - DNA, 660 bp, Artificial Sequence
  Description of Artificial Sequence: Synthetic coding sequence
atgctgagagccggcgcccccaccggcgacctgcccagagccggcgaggtgcacaccggcaccaccatcatggccgtggagttcgacggcggcgtggtgatgggcagcgacagcagagtgagcgccggcgaggccgtggtgaacagagtgttcgacaagctgagccccctgcacgagcacatctactgcgccctgagcggcagcgccgccgacgcccaggccgtggccgacatggccgcctaccagctggagctgcacggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacgccatcgccctggccatgagcagagacggcagcagcggcggcgtgatctacctggtgaccatcaccgccgccggcgtggaccacagagtgatcctgggcaacgagctgcccaagttctacgacgagtag

SEQ ID NO: 94984 - DNA, 591 bp, Artificial Sequence; identical to SEQ ID NO: 94980
  Description of Artificial Sequence: Synthetic coding sequence

SEQ ID NO: 94985 - DNA, 660 bp, Artificial Sequence; identical to SEQ ID NO: 94983
  Description of Artificial Sequence: Synthetic coding sequence

SEQ ID NO: 94986 - DNA, 396 bp, Artificial Sequence; identical to SEQ ID NO: 94972
  Description of Artificial Sequence: Synthetic coding sequence

SEQ ID NO: 94987 - DNA, 396 bp, Artificial Sequence; identical to SEQ ID NO: 94977
  Description of Artificial Sequence: Synthetic coding sequence

SEQ ID NO: 94988 - DNA, 591 bp, Artificial Sequence; identical to SEQ ID NO: 94980
  Description of Artificial Sequence: Synthetic coding sequence

SEQ ID NO: 94989 - DNA, 660 bp, Artificial Sequence; identical to SEQ ID NO: 94963
  Description of Artificial Sequence: Synthetic coding sequence

SEQ ID NO: 94990 - DNA, 537 bp, Artificial Sequence; identical to SEQ ID NO: 94967
  Description of Artificial Sequence: Synthetic coding sequence

SEQ ID NO: 94991 - DNA, 537 bp, Artificial Sequence; identical to SEQ ID NO: 94967
  Description of Artificial Sequence: Synthetic coding sequence

SEQ ID NO: 94992 - DNA, 591 bp, Artificial Sequence; identical to SEQ ID NO: 94966
  Description of Artificial Sequence: Synthetic coding sequence

SEQ ID NO: 94993 - DNA, 660 bp, Artificial Sequence; identical to SEQ ID NO: 94983
  Description of Artificial Sequence: Synthetic coding sequence

SEQ ID NO: 94994 - DNA, 465 bp, Artificial Sequence
  Description of Artificial Sequence: Synthetic coding sequence
atgctgagagccggcgcccccaccggcgacctgcccagagccggcgaggtgcacaccggcaccaccatcatggccgtggagttcgacggcggcgtggtgatgggcagcgacagcagagtgagcgccggcatcgagctggaggagccccccctggtgctggccgccgccaacgtggtgagaaacatcagctacaagtacagagaggacctgagcgcccacctgatggtggccggctgggaccagagagagggcggccaggtgtacggcaccctgggcggcatgctgaccagacagcccttcgccatcggcggcagcggcagcaccttcatctacggctacgtggacgccgcctacaagcccggcatgagccccgaggagtgcagaagattcaccaccgacggcaaccagcccagcggcagagtgcccggcgagggcttcgagacctgggagggcagcagactgtag

SEQ ID NO: 94995 - DNA, 396 bp, Artificial Sequence; identical to SEQ ID NO: 94977
  Description of Artificial Sequence: Synthetic coding sequence

SEQ ID NO: 94996 - DNA, 465 bp, Artificial Sequence; identical to SEQ ID NO: 94994
  Description of Artificial Sequence: Synthetic coding sequence

SEQ ID NO: 94997 - DNA, 465 bp, Artificial Sequence; identical to SEQ ID NO: 94994
  Description of Artificial Sequence: Synthetic coding sequence

SEQ ID NO: 94998 - DNA, 465 bp, Artificial Sequence; identical to SEQ ID NO: 94994
  Description of Artificial Sequence: Synthetic coding sequence

SEQ ID NO: 94999 - DNA, 465 bp, Artificial Sequence; identical to SEQ ID NO: 94994
  Description of Artificial Sequence: Synthetic coding sequence

SEQ ID NO: 95000 - DNA, 465 bp, Artificial Sequence; identical to SEQ ID NO: 94994
  Description of Artificial Sequence: Synthetic coding sequence

SEQ ID NO: 95001 - DNA, 465 bp, Artificial Sequence; identical to SEQ ID NO: 94994
  Description of Artificial Sequence: Synthetic coding sequence

SEQ ID NO: 95002 - DNA, 465 bp, Artificial Sequence; identical to SEQ ID NO: 94994
  Description of Artificial Sequence: Synthetic coding sequence

SEQ ID NO: 95003 - DNA, 426 bp, Artificial Sequence
  Description of Artificial Sequence: Synthetic coding sequence
atgaacgccagaggcctgggcagcgagctgaaggacagcatccccgtgaccgagctgagcgccagcggccccttcgagagccacgacctgctgagaaagggcttcagctgcgtgaagaacgagctgctgcccagccaccccctggagctgagcgagaagaacttccagctgaaccaggacaagatgaacttcagcaccctgagaaacatccagggcctgttcgcccccctgaagctgcagatggagttcaaggccgtgcagcaggtgcagagactgcccttcctgagcagcagcaacctgagcctggacgtgctgagaggcaacgacgagaccatcggcttcgaggacatcctgaacgaccccagccagagcgaggtgatgggcgagccccacctgatggtggagtacaagctgggcctgctgtag

SEQ ID NO: 95004 - DNA, 471 bp, Artificial Sequence
  Description of Artificial Sequence: Synthetic coding sequence
atgcccatggccggcctgctgaagggcctggtgagacagctggagagattcagcgtgcagcagcaggccagcaagatgccccccaagggcaagagcggcagcggcaaggccggcaagggcggcgccgccagcggcagcgacagcgccgacaagaaggcccagggccccaagggcggcggcaacgccgtgaaggtgagacacatcctgtgcgagaagcacggcaagatcatggaggccatggagaagctgaagagcggcatgagattcaacgaggtggccgcccagtacagcgaggacaaggccagacagggcggcgacctgggctggatgaccagaggcagcatggtgggccccttccaggaggccgccttcgccctgcccgtgagcggcatggacaagcccgtgttcaccgacccccccgtgaagaccaagttcggctaccacatcatcatggtggagggcagaaagtag

SEQ ID NO: 95005 - DNA, 402 bp, Artificial Sequence
  Description of Artificial Sequence: Synthetic coding sequence
atgcccatggccggcctgctgaagggcctggtgagacagctggagagattcagcgtgcagcagcaggccagcaagatgccccccaagggcaagagcggcagcggcaaggccggcaagggcggcgccgccagcggcagcgacagcgccgacaagaaggcccagggccccaagggcggcggcaacgccgtgaaggtgagacacatcctgtgcgagaagcacggcaagatcatggaggccatggagaagctgaagagcggcatgagattcaacgaggtggccgcccagtacagcgaggacaaggccagacagggcatccccagcctgcagcagcacgccggccaccacagagacctgagaagcaccctgatcagcctggtgagctacctgcagaccaccccctag

SEQ ID NO: 95006 - DNA, 1062 bp, Artificial Sequence
  Description of Artificial Sequence: Synthetic coding sequence
atggccgccgccgaggccgccaactgcatcatggaggtgagctgcggccaggccgagagcagcgagaagcccaacgccgaggacatgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagacagtacaaggactacaagatccactggtgggagaacgtgtacggcttcgacatgagctgcatcaaggacgtggccatcaaggagcccctggtggacgtggtggaccccaagcagctggtgaccaacgcctgcctgatcaaggaggtggacatctacaccgtgaaggtggaggacctgaccttcaccagccccttctgcctgcaggtgaagagaaacgactacgtgcacgccctggtggcctacttcaacatcgagttcaccagatgccacaagagaaccggcttcagcaccagccccgagagcccctacacccactggaagcagaccgtgttctacatggaggactacctgaccgtgaagaccggcgaggagatcttcggcaccatcggcatgagacccaacgccaagaacaacagagacctggacttcaccatcgacctggacttcaagggccagctgtgcgagctgagctgcagcaccgactacagaatgagatag

SEQ ID NO: 95007 - DNA, 882 bp, Artificial Sequence
  Description of Artificial Sequence: Synthetic coding sequence
atggtgggcgtggccgaggtgagctgcggccaggccgagagcagcgagaagcccaacgccgaggacatgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagacagtacaaggactacaagatccactggtgggagaacgtgtacggcttcgacatgagctgcatcaaggacgtggccatcaaggagcccctggtggacgtggtggaccccaagcagctggtgaccaacgcctgcctgatcaaggtgagaggctgggcctggcccggcgccccctgggtggagaccaaggagagacccagccccggccccggcatgggcctgtggggccccgagtgctggcccgaggtgagcgagcccgacctgcccgccagaggcggcgccagaggccccggcaagaccctgagacccctgaacatcttcgtgagcgccgccgtgtag

SEQ ID NO: 95008 - DNA, 1116 bp, Artificial Sequence
  Description of Artificial Sequence: Synthetic coding sequence
atggccgccgccgaggccgccaactgcatcatggagaacttcgtggccaccctggccaacggcatgagcctgcagccccccctggaggaggtgagctgcggccaggccgagagcagcgagaagcccaacgccgaggacatgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagacagtacaaggactacaagatccactggtgggagaacgtgtacggcttcgacatgagctgcatcaaggacgtggccatcaaggagcccctggtggacgtggtggaccccaagcagctggtgaccaacgcctgcctgatcaaggaggtggacatctacaccgtgaaggtggaggacctgaccttcaccagccccttctgcctgcaggtgaagagaaacgactacgtgcacgccctggtggcctacttcaacatcgagttcaccagatgccacaagagaaccggcttcagcaccagccccgagagcccctacacccactggaagcagaccgtgttctacatggaggactacctgaccgtgaagaccggcgaggagatcttcggcaccatcggcatgagacccaacgccaagaacaacagagacctggacttcaccatcgacctggacttcaagggccagctgtgcgagctgagctgcagcaccgactacagaatgagatag

SEQ ID NO: 95009 - DNA, 483 bp, Artificial Sequence
  Description of Artificial Sequence: Synthetic coding sequence
atgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagatag

SEQ ID NO: 95010 - DNA, 618 bp, Artificial Sequence
  Description of Artificial Sequence: Synthetic coding sequence
atgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagacagtacaaggactacaagatccactggtgggagaacgtgtacggcttcgacatgagctgcatcaaggacgtggccatcaaggagcccctggtggacgtggtggaccccaagcagctggtgaccaacgcctgcctgtag

SEQ ID NO: 95011 - DNA, 483 bp, Artificial Sequence; identical to SEQ ID NO: 95009
  Description of Artificial Sequence: Synthetic coding sequence

SEQ ID NO: 95012 - DNA, 630 bp, Artificial Sequence
  Description of Artificial Sequence: Synthetic coding sequence
atgaccagcaaggactactacttcgacagctacgcccacttcggcatccacgaggagatgctgaaggacgaggtgagaaccctgacctacagaaacagcatgttccacaacagacacctgttcaaggacaaggtggtgctggacgtgggcagcggcaccggcatcctgtgcatgttcgccgccaaggccggcgccagaaaggtgatcggcatcgagtgcagcagcatcagcgactacgccgtgaagatcgtgaaggccaacaagctggaccacgtggtgaccatcatcaagggcaaggtggaggaggtggagctgcccgtggagaaggtggacatcatcatcagcgagtggatgggctactgcctgttctacgagagcatgctgaacaccgtgctgtacgccagagacaagtggctggcccccgacggcctgatcttccccgacagagccaccctgtacgtgaccgccatcgaggacagacagtacaaggactacaagatccactggtgggagaacgtgtacggcttcgacatgagctgcatcaaggacgtggccatcaaggagcccctggtggacgtggtggaccccaagcagctggtgaccaacgcctgcctgatcaaggtgagatag

SEQ ID NO: 95013 - DNA, 687 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctggtgggcgagaaggtgttccccatctggagatag

SEQ ID NO: 95014 - DNA, 855 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctggccgcccccctgctgagctgcagaatcctgccctgcacctgcgccagcggccccctgcacgtgctgctggcctgctgcctgcccctgccctgcacctgcgccagcgtgcccctgcacgtgctgctggcctgctgcctgcccgtgctgagagccccccagcccagcggcctgcacctgagctggcccatcttcctgctgtag

SEQ ID NO: 95015 - DNA, 1302 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctgttcgagttcatgatcgagagcatcctgtacgccagagacgcctggctgaaggaggacggcgtgatctggcccaccatggccgccctgcacctggtgccctgcagcgccgacaaggactacagaagcaaggtgctgttctgggacaacgcctacgagttcaacctgagcgccctgaagagcctggccgtgaaggagttcttcagcaagcccaagtacaaccacatcctgaagcccgaggactgcctgagcgagccctgcaccatcctgcagctggacatgagaaccgtgcagatcagcgacctggagaccctgagaggcgagctgagattcgacatcagaaaggccggcaccctgcacggcttcaccgcctggttcagcgtgcacttccagagcctgcaggagggccagcccccccaggtgctgagcaccggccccttccaccccaccacccactggaagcagaccctgttcatgatggacgaccccgtgcccgtgcacaccggcgacgtggtgaccggcagcgtggtgctgcagagaaaccccgtgtggagaagacacatgagcgtggccctgagctgggccgtgaccagcagacaggaccccaccagccagaaggtgggcgagaaggtgttccccatctggagatag

SEQ ID NO: 95016 - DNA, 486 bp, Artificial Sequence
  Description of Artificial Sequence: Synthetic coding sequence
atgctggccgaccagcccagaaccaccaagtaccacagcgtgatcctgcagaacaaggagagcctgagaatcaagagcagctggacctgggccgtgggcctgggcagcagcgtgagcagcgtgcacaccatgagaggcctggagagagtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctgttcgagttcatgatcgagagcatcctgtacgccagagacgcctggctgaaggagaccggcagcttcggccccccctggctgagatgcaccctgtgccccgccgtgctgatcagaatcatcgtggccagatgcagcagcggcaccaccagaaccagcagcaccagcgccctgtag

SEQ ID NO: 95017 - DNA, 1302 bp, Artificial Sequence; identical to SEQ ID NO: 95015
  Description of Artificial Sequence: Synthetic coding sequence

SEQ ID NO: 95018 - DNA, 1302 bp, Artificial Sequence; identical to SEQ ID NO: 95015
  Description of Artificial Sequence: Synthetic coding sequence

SEQ ID NO: 95019 - DNA, 996 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctgaccctgagaggcgagctgagattcgacatcagaaaggccggcaccctgcacggcttcaccgcctggttcagcgtgcacttccagagcctgcaggagggccagcccccccaggtgctgagcaccggccccttccaccccaccacccactggaagcagaccctgttcatgatggacgaccccgtgcccgtgcacaccggcgacgtggtgaccggcagcgtggtgctgcagagaaaccccgtgtggagaagacacatgagcgtggccctgagctgggccgtgaccagcagacaggaccccaccagccagaaggtgggcgagaaggtgttccccatctggagatag

SEQ ID NO: 95020 - DNA, 870 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctgttcgagttcatgatcgagagcatcctgtacgccagagacgcctggctgaaggaggacggcgtgatctggcccaccatggccgccctgcacctggtgccctgcagcgccgacaaggactacagaagcaaggtgctgttctgggacaacgcctacgagttcaacctgagcgccctgaagctggagaagaagagcagccccagcggcgacgacagctag

SEQ ID NO: 95021 - DNA, 906 bp, Artificial Sequence
  Description of Artificial Sequence: Synthetic coding sequence
atggccaccagcggcgactgccccagaagcgagagccagggcgaggagcccgccgagtgcagcgaggccggcctgctgcaggagggcgtgcagcccgaggagttcgtggccatcgccgactacgccgccaccgacgagacccagctgagcttcctgagaggcgagaagatcctgatcctgagacagaccaccgccgactggtggtggggcgagagagccggctgctgcggctacatccccgccaaccacgtgggcaagcacgtggacgagtacgaccccgaggacacctggcaggacgaggagtacttcggcagctacggcaccctgaagctgcacctggagatgctggccgaccagcccagaaccaccaagtaccacagcgtgatcctgcagaacaaggagagcctgaccgacaaggtgatcctggacgtgggctgcggcaccggcatcatcagcctgttctgcgcccactacgccagacccagagccgtgtacgccgtggaggccagcgagatggcccagcacaccggccagctggtgctgcagaacggcttcgccgacatcatcaccgtgtaccagcagaaggtggaggacgtggtgctgcccgagaaggtggacgtgctggtgagcgagtggatgggcacctgcctgctgcaccacaccctggaggccgacgccgtgcacgacggcagacccagcccctgcccctacagaagaagaggccacggcttcagctgcgtggccgagaagcccagcgtggagaaggcccacgtgtgcggcagcgagctgggctgccacttccagaccagaccccacatcagcaagagctggagaaagagcctgccccacctggagatgaccgtggacgccctgttcggcaagcagtgcgcctacctggagggctag

SEQ ID NO: 95022 - DNA, 951 bp, Artificial Sequence
  Description of Artificial Sequence: Synthetic coding sequence
atgatcgccgacagagtgagaaccgacgcctacagactgggcatcctgagaaactgggccgccctgagaggcaagaccgtgctggacgtgggcgccggcaccggcatcctgagcatcttctgcgcccaggccggcgccagaagagtgtacgccgtggaggccagcgccatctggcagcaggccagagaggtggtgagattcaacggcctggaggacagagtgcacgtgctgcccggccccgtggagaccgtggagctgcccgagcaggtggacgccatcgtgagcgagtggatgggctacggcctgctgcacgagagcatgctgagcagcgtgctgcacgccagaaccaagtggctgaaggagggcggcctgctgctgcccgccagcgccgagctgttcatcgcccccatcagcgaccagatgctggagtggagactgggcttctggagccaggtgaagcagcactacggcgtggacatgagctgcctggagggcttcgccaccagatgcctgatgggccacagcgagatcgtggtgcagggcctgagcggcgaggacgtgctggccagaccccagagattcgcccagctggagctgagcagagccggcctggagcaggagctggaggccggcgtgggcggcagattcagatgcagctgctacggcagcgcccccatgcacggcttcgccatctggttccaggtgaccttccccggcggcgagagcgagaagcccctggtgctgagcaccagccccttccaccccgccacccactggaagcaggccctgctgtacctgaacgagcccgtgcaggtggagcaggacaccgacgtgagcggcgagatcaccctgctgcccagcagagacaaccccagaagactgagagtgctgctgagatacaaggtgggcgaccaggaggagaagaccaaggacttcgccatggaggactag

SEQ ID NO: 95023 - DNA, 1128 bp, Artificial Sequence
  Description of Artificial Sequence: Synthetic coding sequence
atgagccagcccaagaagagaaagctggagagcggcggcggcggcgagggcggcgagggcaccgaggaggaggacggcgccgagagagaggccgccctggagagacccagaagaaccaagagagagagagaccagctgtactacgagtgctacagcgacgtgagcgtgcacgaggagatgatcgccgacagagtgagaaccgacgcctacagactgggcatcctgagaaactgggccgccctgagaggcaagaccgtgctggacgtgggcgccggcaccggcatcctgagcatcttctgcgcccaggccggcgccagaagagtgtacgccgtggaggccagcgccatctggcagcaggccagagaggtggtgagattcaacggcctggaggacagagtgcacgtgctgcccggccccgtggagaccgtggagctgcccgagcaggtggacgccatcgtgagcgagtggatgggctacggcctgctgcacgagagcatgctgagcagcgtgctgcacgccagaaccaagtggctgaaggagggcggcctgctgctgcccgccagcgccgagctgttcatcgcccccatcagcgaccagatgctggagtggagactgggcttctggagccaggtgaagcagcactacggcgtggacatgagctgcctggagggcttcgccaccagatgcctgatgggccacagcgagatcgtggtgcagggcctgagcggcgaggacgtgctggccagaccccagagattcgcccagctggagctgagcagagccggcctggagcaggagctggaggccggcgtgggcggcagattcagatgcagctgctacggcagcgcccccatgcacggcttcgccatctggttccaggtgaccttccccggcggcgagagcgagaagcccctggtgctgagcaccagccccttccaccccgccacccactggaagcaggccctgctgtacctgaacgagcccgtgcaggtggagcaggacaccgacgtgagcggcgagatcaccctgctgcccagcagagacaaccccagaagactgagagtgctgctgagatacaaggtgggcgaccaggaggagaagaccaaggacttcgccatggaggactag

SEQ ID NO: 95024 - DNA, 936 bp, Artificial Sequence
  Description of Artificial Sequence: Synthetic coding sequence
atggccagaagcggcagaagaccctggagcgaccccggcggcctgagcggcgccgtgcagagagccggcggccccggcgccagacccgccggcaccagcggcgactgcagagtggccggcaccggcggctgccacagagagagagtggacggcctgagaacccccgccagagtgcacgccgagctgagaccccccagagccaaccaggtggccgagggcggcagaagcagccccgccggcctgagaagagccctgcacagcccccaccagagacccgacgccggcatggcccccggcctgctggagcccggcgaggccgccctgtggtgcggccacgagctgcccggcggcctgagacacgccctgagccacggccccctgggcgacagatgcgccggcatcgtgagaagaggcagagccggccccgccgccgccctgtgcagcgccagagccctgcccagaagactgggcgccggcgccggcggcagaagcggcagagccctgcccctgcagctgctgtggctgggcgcccacgcctggctgtgccacctggtgcccggcgacctgccctggagaggcgtgggcgagacccccggcgccgtgcacctggccttcagccccggccacagcctggagaccggcgcccccctgcccgagagagccggcgccagcggcgccagacacggcagattcagaagagaccacgccgccgccctgcccggccagccccccagccccgccagagccgccgccctgcagagcggcagacccggcggcgaggaccagagactgtgccacggcggcctgagcgtggccttcagccccagctacctgcccaagcagcccgacctgagaggcagaggcgtggccagaagcgagggcaagggcagaagccacgtgcaggtgggcggcatcagcccccccttccccagctag

SEQ ID NO: 95025 - DNA, 2532 bp, Artificial Sequence
  Description of Artificial Sequence: Synthetic coding sequence
atggccaagcccctgaccgacagcgagaagagaaagcagatcagcgtgagaggcctggccggcctgggcgacgtggccgaggtgagaaagagcttcaacagacacctgcacttcaccctggtgaaggacagaaacgtggccacccccagagactacttcttcgccctggcccacaccgtgagagaccacctggtgggcagatggatcagaacccagcagcactactacgagagagaccccaagagaatctactacctgagcctggagttctacatgggcagaaccctgcagaacaccatggtgaacctgggcctgcagaacgcctgcgacgaggccatctaccagctgggcctggacctggaggagctggaggagatcgaggaggacgccggcctgggcaacggcggcctgggcagactggccgcctgcttcctggacagcatggccaccctgggcctggccgcctacggctacggcatcagatacgagttcggcatcttcaaccagaagatcgtgaacggctggcaggtggaggaggccgacgactggctgagatacggcaacccctgggagaaggccagacccgagtacatgctgcccgtgcacttctacggcagagtggagcacacccccgacggcgtgaagtggctggacacccaggtggtgctggccatgccctacgacacccccgtgcccggctacaagaacaacaccgtgaacaccatgagactgtggagcgccaaggcccccaacgacttcaagctgcaggacttcaacgtgggcgactacatcgaggccgtgctggacagaaacctggccgagaacatcagcagagtgctgtaccccaacgacaacttcttcgagggcaaggagctgagactgaagcaggagtacttcgtggtggccgccaccctgcaggacatcatcagaagattcaagagcagcaagttcggctgcagagaccccgtgagaacctgcttcgagaccttccccgacaaggtggccatccagctgaacgacacccaccccgccctgagcatccccgagctgatgagaatcctggtggacgtggagaaggtggactgggacaaggcctgggagatcaccaagaagacctgcgcctacaccaaccacaccgtgctgcccgaggccctggagagatggcccgtgagcatgttcgagaagctgctgcccagacacctggagatcatctacgccatcaaccagagacacctggaccacgtggccgccctgttccccggcgacgtggacagactgagaagaatgagcgtgatcgaggagggcgactgcaagagaatcaacatggcccacctgtgcgtgatcggcagccacgccgtgaacggcgtggccagaatccacagcgagatcgtgaagcagagcgtgttcaaggacttctacgagctggagcccgagaagttccagaacaagaccaacggcatcacccccagaagatggctgctgctgtgcaaccccggcctggccgacaccatcgtggagaagatcggcgaggagttcctgaccgacctgagccagctgaagaagctgctgcccctggtgagcgacgaggtgttcatcagagacgtggccaaggtgaagcaggagaacaagctgaagttcagcgccttcctggagaaggagtacaaggtgaagatcaaccccagcagcatgttcgacgtgcacgtgaagagaatccacgagtacaagagacagctgctgaactgcctgcacgtggtgaccctgtacaacagaatcaagagagaccccgccaaggccttcgtgcccagaaccgtgatgatcggcggcaaggccgcccccggctaccacatggccaagctgatcatcaagctggtgaccagcatcggcgacgtggtgaaccacgaccccgtggtgggcgacagactgaaggtgatcttcctggagaactacagagtgagcctggccgagaaggtgatccccgccgccgacctgagccagcagatcagcaccgccggcaccgaggccagcggcaccggcaacatgaagttcatgctgaacggcgccctgaccatcggcaccatggacggcgccaacgtggagatggccgaggaggccggcgccgagaacctgttcatcttcggcctgagagtggaggacgtggaggccctggacagaaagggctacaacgccagagagtactacgaccacctgcccgagctgaagcaggccgtggaccagatcagcagcggcttcttcagccccaaggagcccgactgcttcaaggacatcgtgaacatgctgatgcaccacgacagattcaaggtgttcgccgactacgaggcctacatgcagtgccaggcccaggtggaccagctgtacagaaaccccaaggagtggaccaagaaggtgatcagaaacatcgcctgcagcggcaagttcagcagcgacagaaccatcaccgagtacgccagagagatctggggcgtggagcccagcgacctgcagatccccccccccaacatccccagagactag

SEQ ID NO: 95026 - DNA, 717 bp, Artificial Sequence
  Description of Artificial Sequence: Synthetic coding sequence
atgctgaccaccctgctgcccatcctgctgctgagcggctgggccttctgcagccaggacgccagcgacggcctgcagagactgcacatgctgcagatcagctacttcagagacccctaccacgtgtggtaccagggcaacgccagcctgggcggccacctgacccacgtgctggagggccccgacaccaacaccaccatcatccagctgcagcccctgcaggagcccgagagctgggccagaacccagagcggcctgcagagctacctgctgcagttccacggcctggtgagactggtgcaccaggagagaaccctggccttccccctgaccatcagatgcttcctgggctgcgagctgccccccgagggcagcagagcccacgtgttcttcgaggtggccgtgaacggcagcagcttcgtgagcttcagacccgagagagccctgtggcaggccgacacccaggtgaccagcggcgtggtgaccttcaccctgcagcagctgaacgcctacaacagaaccagatacgagctgagagagttcctggaggacacctgcgtgcagtacgtgcagaagcacatcagcgccgagaacaccaagggcagccagaccagcagaagctacaccagcctggtgctgggcgtgctggtgggcagcttcatcatcgccggcgtggccgtgggcatcttcctgtgcaccggcggcagaagatgctag

SEQ ID NO: 95027 - DNA, 4551 bp, Artificial Sequence
  Description of Artificial Sequence: Synthetic coding sequence
atggacaaccagcaggacaaggccatcgtggccagcgccaacggcgagaacaccctgatcaacggcgtgaaggagaacgacagcgaggaccaggacgtggccatgaagagcttcgccgccctggaggccgccgcccccatccagcccacccccgtggcccagaaggagaccctgatgtaccccagaggcctgctgcccctgcccagcaagaagccctgcatgcagagcccccccagccccctgggcctgatcgaggcccccgagcacgccgccaacagcgccagcgtgaacgccatcagcctgaccagcggcatcgccaagggcctgaacacctggagcctgcccaacgagtgcgagaaggcccccttcgccatcatggagcccgccggcatgagcgccctgaacggcgactgcctgatgcagcccagcagaacctgcctgggctgcttcatggagagcaaggacgccgtggaccccgagcccggcatcagcctgaaggtgggcgacctgaacagagactacgagacctgcgccgtgagcgacatcggcatccagtgcatcaacgccggcgagaacatgaagtacggcgagcagctgctgagcgaccagctgctgggcttccccctgcacaagagcagagccggcgacagaagagagaccgagaagcccgacatcgacctggaggaccccgcccagaagagctactacgaggccctgctgctggacaagtgcaacaccgaggaggccctgctggccaacagcaaccaggactggggctacttcgagaccttcatcagcgagagcaagatcgagctgctggacctgtgcagcaagaacgagctgagcgtgaacctgttcagcgaggaggacgtggacaactacatgttcgacgacgacgagagcaccctgggcagcgacgtgtgcagcctgaagatcagatacgagagcttccaggacaacgtgagagacaagaccaccctgctgatgcaggaggacgcccagttcaacttcttccccagcgtgttcaccacctgccccaagagagagagcaagagcggcgccctgaagcagagcagcgacttcagccagttcaaggtgcccgacgtgagcatcatctggggcgaggaggacaagaacctggacaagaagaagggcaaggaggagggccaggaggacaagggcgtggagaagaaggacggcaaggacaacggcgagaagcccgccctgaacaagccctgcagcggcaccgaggtggagcagctgaagaaccccaagcagggccacctggccaacagcctggagaccagcggcagcttcagcgacgacagcagcttcatcgagatcagctacgacgccatgggcgagatcaaggactgcagcagatacatggccagagacaccaacagcggcagcagcagcagccagcagaactacggcctgagagccaagagaaaggtgagatacagcgaggactacctgtacgacgtggacagcctggagggcgagaaggtgaacgagagaaaggagtggctgcccgtgggcagcaaggaggaggacgacgacgagtggtgccccaagaagagaagaaaggtgaccagaaaggagccccccgtgatcatcaagtacatcatcatcaacagattcaagggcgagaagaacatgctggtgaagctgggcaaggtggacgccagcgagaccaccgtgaacctgagcgagaaccagctgaacaagtacgccaagctggcccccctgaagggcttctggcagaagaagaagaagcagagaaacaccaacaccgacagcatcaagacccccttcagccagaagcagagcttcgagcccggcagcttcgaggtgagcttcctgccccccgccagaaagagaaagagcaagctgggcaacagacacagaatccagagaatccccagcatcgagatcagcgccagcagcaagcagatcagcctgtgcaacgaccagagacacgccagcaaccacaaggaggacggcggcctgaagggcaccctgaagagcgcccccctgggcgcccccagctgcgccaacggcagccacctgaacgacatcaccggccccgacagcgtgaaggtgaaggcccaggacaccgagttcaagggccccgagagaaaggtgctgaacaagatcaagttcaagagcgaggccagactgaagagcaagaaggtgaaggccgccggccaggagagcaagcccatcgtgcagatgagccccctgctggagaaccagagcagcaaggccaacctgaagaacgaggtgatccccggcaccagcaacagcagcagactgagcgagttccacgaggccaaggccgccaagagcagcaccttcctgcccaccacctgcagcagcgagatgcccctgagcagcgccaacgtgaccaccaacatccccgtgatccccggcggctacctgcagaccctgctggacgccagcgacctgagcaacaacaccagcatcagctacttcagccaccacagccccgagcagaacgagggcagcctgacccagaccgagaagagcttcgtgcccctgcagcccacccaggactgcgtgctgaccagcagcagcgacagcgagctgcagcagagcagccacaacttcaagatggagagcagcaactacagaaacgtgtggcccaacaaggccaccagcggcacccaggagttcatggccgaggtgagcagagagatcgcccccacccagagcagcgagttcggcgccagccaggtggtgagcatggagaacaacctgacccccaccacctacaaccccatctgcctgaacagcggcggcagcaactgcaacaaggtgctgtacgacagcatgcaggacacccagctgcccagcgacgacagctaccagctgtgccacttcaacaacggcgagatctgcttccccttccagcagggccccgtgaacatggacgacggcagactgttcagcttcgacagcatggcccccctgagcgtgagcagcagcaactactgcagcctgagcctgaagagctgcgagaaggacggcgacgacgacatcaccgacgacttcctggcccactgcagccccaagctggtgatccagcagagcatcgacgagatcgcccccctgaaggagagcaccgacctgctggacatcagcaacttcacccccgacaagttcagacacagcagcctgagcgagatgagcccccccgacacccccagcctgagcccccagatcaccagatgcgagagcatgaagaccctgggcaccctgaagggcttccaggagggcgtgcccggccccctggacagcgtggagaagatcaagtgggactgcagcaccctgagcagacaggtgcagatggaggacggcttcaccctgaacaaccaccagttccagttccacatgttcaacgacgaggacagcgtgagcctgctgcagaagaacccctgcctgagcaccttcaacgaccccagcggccagatcagcaccaacaacaaggtgagcaagagcagaaagaagagcagccccagcaagagcggcgccatgaaccagagcagcagccagaagaacaccagaaagaagagcctgaagggcaacaacaagggcatcgagaagccccccggcaagaacagcagacaggtgcccaagagcaccaagaagggcaagtacatggccgccatcaacggcgagaagatgcagatcggcatcggcagaggcggcagccagaccaacaccatcagcagcaccggcaagaccctggccgagtgcatccagcacggcggccccatggccagcatgaagatgcccagccagaagggcctgagcggcgactgggccctgggcaaggagagcagccccggctggagcgacatgagcatgggcaccaacaccaacagcctgctggacgacgaccagagagagttccaggagcccagctacatcctgagcaacatcgccagcggcatggccgacgtgcagagattcatgatggccagcatcgagcccctgtgggagcccatggagcaccacggcgaccccaacatcttctacagccccgagagcaacagcctgaagctgaagaccctgaagatcctggccggcaccccccaggagagcaagaagaagatcaacagcggcagccagggcgccaccaagaaccacagaagcatcaagggcgtgagcaagagcaacggcaagaccgccatcggcgaccccggcagagccaacatgcccggctacaacgaggacagcagaagcaccttcttcgacaagaagtacagcaacatgagcaccctgggcaacaacggccccacccacaagaagctgtacagacacaagagcagcagcaaggccctgagagacgagaagtgcaagggcaagcacatggagagagagcaggtgcacaaggacgagagcggcaccgccagcttcgagaagctgagagacagcgactacaacctgctgaaggccgagaccaccttctgggtgctgcccgtgttcgaggaggagaccagaatcttccagaaggacatctag

SEQ ID NO: 95028 - DNA, 1008 bp, Artificial Sequence
  Description of Artificial Sequence: Synthetic coding sequence
atgtgggccaccctgcccctgctgtgcgccggcgcctggctgctgggcgtgcccgtgtgcggcgccgccgagctgtgcgtgaacagcctggagaagttccacttcaagagctggatgagcaagcacagaaagacctacagcaccgaggagtaccaccacagactgcagaccttcgccagcaactggagaaagatcaacgcccacaacaacggcaaccacaccttcaagatggccctgaaccagttcagcgacatgagcttcgccgagatcaagcacaagtacctgtggagcgagccccagaactgcagcgccaccaagagcaactacctgagaggcaccggcccctacccccccagcgtggactggagaaagaagggcaacttcgtgagccccgtgaagaaccagggcgcctgcggcagctgctggaccttcagcaccaccggcgccctggagagcgccatcgccatcgccaccggcaagatgctgagcctggccgagcagcagctggtggactgcgcccaggacttcaacaaccacggctgccagggcggcctgcccagccaggccttcgagtacatcctgtacaacaagggcatcatgggcgaggacacctacccctaccagggcaaggacggctactgcaagttccagcccggcaaggccatcggcttcgtgaaggacgtggccaacatcaccatctacgacgaggaggccatggtggaggccgtggccctgtacaaccccgtgagcttcgccttcgaggtgacccaggacttcatgatgtacagaaccggcatctacagcagcaccagctgccacaagacccccgacaaggtgaaccacgccgtgctggccgtgggctacggcgagaagaacggcatcccctactggatcgtgaagaacagctggggcccccagtggggcatgaacggctacttcctgatcgagagaggcaagaacatgtgcggcctggccgcctgcgccagctaccccatccccctggtgtag

SEQ ID NO: 95029 - DNA, 5655 bp, Artificial Sequence
  Description of Artificial Sequence: Synthetic coding sequence
atgcactgcaccaaccccgccctgatcttcctgatcgacgagctgagccccgagcagcacaacctgagcctgtacagcatggagctggtgctgaagaagagcaccggccacagcgccgcccaggtggccctgaccgagaccgcccccggcagccagcacagcagccccctgcacgtgaccgccccccccagcgccaccaccttcgacaccgccttcttcaaccagggcaagcagaccaagagcaccgccgaccccagcatcttcgtggccacctacgtgagcgtgaccagcaaggaggtggccgtgaacgacgacgagatggacaacttcctgcccgacacccactggaccacccccagaatggtgagccccatccagtacatcaccgtgagcccccccggcctgcccagagaggccctggagcccatgctgacccccagcctgcccatggtgagcctgcaggacgaggaggtgaccagcggctggcagaacaccaccagacagcccgccgcctacgccgagagcgccagccacttccacaccttcagaagcgccttcagaaccagcgagggcatcgtgcccacccccggcagaaacctggtgctgtaccccaccgacgcctacagccacctgagcagcagaaccctgcccgagatcgtggccagcctgaccgagggcgtggagaccaccctgttcctgagcagcagaagcctgatgccccagcccctgggcgacggcatcaccatccccctgcccagcctgggcgaggtgagccagccccccgaggaggtgtgggccaccagcgccgacagatacaccgacgtgaccaccgtgctgagccagagcctggaggagaccatcagccccagaacctaccccaccgtgaccgccagccacgccgccctggccttcagcagaacccacagccccctgctgagcacccccctggccttcgccagcagcgccagccccaccgacgtgagcagcaaccccttcctgcccagcgacagcagcaagaccagcgagctgcacagcaacagcgccctgcccggccccgtggacaacacccacatcctgagccccgtgagcagcttcagaccctacacctggtgcgccgcctgcaccgtgcccagcccccagcaggtgctggccaccagcctgatggagaaggacgtgggcagcggcgacggcgccgagaccctgtgcatgaccgtgctggaggagagcagcatcagcctgatgagcagcgtggtggccgacttcagcgagttcgaggaggacccccaggtgttcaacaccctgttccccagcagacccatcgtgcccctgagcagcagaagcatggagatcagcgagaccagcgtgggcatcagcgccgaggtggacatgagcagcgtgaccaccacccaggtgccccccgcccacggcagactgagcgtgcccgccagcctggaccccaccgccggcagcctgagcgtggccgagacccaggtgacccccagcagcgtgaccaccgccttcttcagcgtgatcaccagcatcctgctggacagcagcttcagcgtgatcgccaacaagaacacccccagcctggccgtgagagaccccagcgtgttcaccccctacagcctggtgcccagcgtggagagcagcctgttcagcgaccaggagagaagcagcttcagcgagcacaagcccagaggcgccctggacttcgccagcagcttcttcagcaccccccccctggagctgagcggcagcatcagcagccccagcgaggcccccgccagcctgagcctgatgcccagcgacctgagccccttcaccagccagagcttcagccccctggtggagaccttcaccctgttcgacagcagcgacctgcagagcagccagctgagcctgcccagcagcaccaacctggagttcagccagctgcagcccagcagcgagctgcccctgaacaccatcatgctgctgcccagcagaagcgaggtgagcccctggagcagcttccccagcgacagcctggagttcgtggaggccagcaccgtgagcctgaccgacagcgaggcccacttcaccagcgccttcatcgagaccaccagctacctggagagcagcctgatcagccacgagagcgccgtgaccgccctggtgccccccggcagcgagagcttcgacatcctgaccgccggcatccaggccaccagccccctgaccaccgtgcacaccacccccatcctgaccgagagcagcctgttcagcaccctgaccccccccgacgaccagatcagcgccctggacggccacgtgagcgtgctggccagcttcagcaaggccatccccaccggcaccgtgctgatcaccgacgcctacctgcccagcggcagcagcttcgtgagcgaggccacccccttccccctgcccaccgagctgaccgtggtgggccccagcctgacccccaccgaggtgcccctgaacaccagcaccgaggtgagcaccaccagcaccggcgccgccaccggcggccccctggacagcaccctgatgggcgacgccgccagccagagcccccccgagagcagcgccgccccccccctgcccagcctgagacccgtgaccgccttcaccctggaggccaccgtggacacccccaccctggccaccgccaagcccccctacgtgtgcgacatcaccgtgcccgacgcctacctgatcaccaccgtgctggccagaagagccgtgcaggagtacatcatcaccgccatcaaggaggtgctgagaatccacttcaacagagccgtggagctgaaggtgtacgagctgttcaccgacttcaccttcctggtgaccagcggccccttcgtgtacaccgccatcagcgtgatcaacgtgctgatcaacagcaagctggtgagagaccagacccccctgatcctgagcgtgaagcccagcttcctggtgcccgagagcagattccaggtgcagaccgtgctgcagttcgtgccccccagcgtggacaccggcttctgcaacttcacccagagaatcgagaagggcctgatgaccgccctgttcgaggtgagaaagcaccaccagggcacctacaacctgaccgtgcagatcctgaacatcaccatcagcagcagcagagtgacccccagaagaggccccgtgaacatcatcttcgccgtgaagagcacccagggcttcctgaacggcagcgaggtgagcgagctgctgagaaacctgagcgtggtggagttcagcttctacctgggctaccccgtgctgcagatcgccgagcccttccagtacccccagctgaacctgagccagctgctgaagagcagctgggtgagaaccgtgctgctgggcgtgatggagaagcagctgcagaacgaggtgttccaggccgagatggagagaaagctggcccagctgctgagcgaggtgagcaccagaagaagaatgtggagaagagccaccgtggccgccggcaacagcgtggtgcaggtggtgaacgtgagcagactggagggcgacgacaaccccgtgcagctgatctacttcgtggaggaccaggacggcgagagactgagcgccgtgaagagcagcgacctgatcaacaagatggacctgcagagagccgccatcatcctgggctacagaatccagggcgtgatcgcccagcccgtggacagagtgaagagacccagccccgagagccagagcaacaacctgtgggtgatcgtgggcgtggtgatccccgtgctggtggtgatggtgatcgtggtgatcctgtactggaagctgtgcagaaccgacaagctggacttccagcccgacaccgtggccaacatccagcagagacagaagctgcagatccccagcgtgaagggcttcgacttcgccaagcagcacctgggccagcacaacaaggacgacatcctgatcatccacgagcccgcccccctgcccggccccctgaaggaccacaccacccccagcgagaacggcgacgtgcccagccccaagagcaagatccccagcaagaacgtgagacacagaggcagagtgagccccagcgacgccgacagcaccgtgagcgaggagagcagcgagagagacgccggcgacaagacccccggcgccgtgaacgacggcagaagccacagagccccccagagcggcccccccctgcccagcagcggcaacgagcagcacagcagcgccagcatcttcgagcacgtggacagaatcagcagaccccccgaggccagcagaagagtgcccagcaagatccagctgatcgccatgcagcccatccccgccccccccgtgcagagacccagccccgccgacagagtggccgagagcaacaagatcaacaaggagatccagaccgccctgagacacaagagcgagatcgagcaccacagaaacaagatcagactgagagccaagagaagaggccactacgagttccccgtggtggacgacctgagcagcggcgacaccaaggagagacacagagtgtacagaagagcccagatgcagatcgacaagatcctggaccccaccgccagcgtgcccagcgtgttcatcgagcccagaaagagcagcagaatcaagagaagccccaagcccagaagaaagcaccaggtgaacggctgccccgccgacgccgagaaggacagactgatcaccaccgacagcgacggcacctacagaagaccccccggcgtgcacaacagcgcctacatcggctgccccagcgaccccgacctgcccgccgacgtgcagacccccagcagcgtggagctgggcagataccccgccctgcccttccccgccagccagtacatccccccccagcccagcatcgaggaggccagacagaccatgcacagcctgctggacgacgccttcgccctggtggcccccagcagccagcccgccagcaccgccggcgtgggccccggcgtgccccccggcctgcccgccaacagcacccccagccaggaggagagaagagccacccagtggggcagcttctacagccccgcccagaccgccaacaacccctgcagcagatacgaggactacggcatgaccccccccaccggccccctgcccagacccggcttcggccccggcctgctgcagagcaccgagctggtgccccccgacccccagcagccccaggccagcgccgaggcccccttcgccgccagaggcatctacagcgaggagatgcccagcgtggccagacccagacccgtgggcggcaccaccggcagccagatccagcacctgacccaggtgggcatcgccagcagaatcggcgcccagcccgtggagatcccccccagcagaggcagccagtacggcggccccggctggcccagctacggcgaggacgaggccggcagaagagaggccgtgcccagaaccagcggcagagagcccagcgcccccagcggcaacctgccccacagaggcctgcagggccccggcctgggctaccccaccagcagcaccgaggacctgcagcccggccacagcagcgccagcctgatcaaggccatcagagaggagctgctgagactgagccagaagcagagcaccgtgcagaacttccacagctag

SEQ ID NO: 95030 - DNA, 1236 bp, Artificial Sequence
  Description of Artificial Sequence: Synthetic coding sequence
atggagacccccgaggtgcccgtgggcagcctgatcgacttcggccccgaggcccccaccagcagccccctggaggcccccccccccgtgctgcaggacggcgacggcagcctgggcgacggcgccagcgagagcgagaccaccgagagcgccgacagcgagaacgacatgggcgagagccccagccaccccagctgggaccaggacagaagaagcagcagcaacgagagcttcagcagcaaccagagcaccgagagcacccaggacgaggagaccctggccctgagagacttcatgagaggctacgtggagaagatcttcagcggcggcgaggacctggaccaggaggagaaggccaagttcggcgagtactgcagcagcgagaacggcaagggcagagagtggttcgccagatacgtgagcgcccagagatgcaacagcaagtgcgtgagcgaggccaccttctacagactggtgcagagcttcgccgtggtgctgttcgagtgccaccagatggacgacttcggccccgccaagaacctgatgaccatgtgcttcacctactaccacatcggcaagccccagctgctgccccccgagagcagagagaagcccgccggcagcatcgacagctacctgaagagcgccaacagctggctggccgagaagaaggacatcgccgagagactgctgaagaacaccagcgccagaaccgagaacgtgaagggcttcttcggcggcctggagaccaagctgaagggccccctggccagaagaaacgaggaggacgagaacaagccccaggagaagagacccagagccgtgaccgcctacagccccgaggacgagaagaagggcgagaagatctacctgtacacccacctgaagcagcagcccatctggcacaccctgagattctggaacgccgccttcttcgacgccgtgcactgcgagagaaccaagagaagccccaccaccagaggcgacgccggcgaggaggaggagaagagagagaagtggtgccacatgacccaggaggagagagacgacagcctgagattcaacgagaacatcaccttcggccagctgggcaccttcacccacaacatgctggccttcggcctgaacaagaagctgtgcaacgacttcctgaagaagcaggccgtgatcggcaacctggacgaggagcagtacaagctgctgagcgaccacatcgagcagatggccaccgagtag

SEQ ID NO: 95031 - DNA, 15018 bp, Artificial Sequence
  Description of Artificial Sequence: Synthetic coding sequence
atggaccagagaaagaacgagagcatcgtgcccagcatcacccagctggaggacttcctgaccgagcacaacagcaacgtggtgtggctgctggtggccaccatcctgagctgcggctggatcatctacctgacctactacaacagcagaaacgtgggcctgatcctgaccctggtgctgaacagactgtacaagcacggctacatccacatcggcagcttcagcttcagcgtgctgagcggcaaggtgatggtgagagagatctactacatcaccgaggacatgagcatcagaatccaggacggcttcatcatcttcagatggtggaagatgtacaaccccaagcagaagcagcacgaccccaaggccgagaccagactgtacatcaccgtgaacgacttcgagttccacgtgtacaacagaagcgacctgtacggcagactgcaggagctgttcggcctggagcccaccatcatcccccccaagaaggacgacgacaagaccagagagatcggcagaaccagaacccagagcaagatcgagagagtgaaggtgaagaccgagagccaggaccccaccagcagctggagaagcctgatccccgtgatcaaggtgaacgtgagcaccggcagactggccttcggcaaccactaccagccccagaccctgtgcatcaacttcgacgacgccttcctgacctacaccaccaagccccccagcagccacctggaccagttcatgcacatcgtgaagggcaagctggagaacgtgagagtgatgctggtgcccagccccagatacgtgggcctgcagaacgacgagccccccagactgatgggcgagggcttcgtggtgatgcagagcaacgacgtggacatctactactacatggacgagcccggcctggtgcccgaggagaccgaggagaacatcgagggcgagatgagcagcgaggactgcaagctgcaggacctgcccccctgctggggcctggacatcgtgtgcggcaagggcaccgacttcaactacggcccctgggccgacagacagagagactgcctgtggaagttcttcttcccccccgactaccaggtgctgaaggtgagcgagatcgcccagcccggcagacccagacagatcctggccttcgagctgagaatgaacatcatcgccgacgccaccatcgacctgctgttcaccaagaacagagagaccaacgccgtgcacgtgaacgtgggcgccggcagctacctggagatcaacatccccatgaccgtggaggagaacggctacacccccgccatcaagggccagctgctgcacgtggacgccaccaccagcatgcagtacagaaccctgctggaggccgagatgctggccttccacatcaacgccagctaccccagaatctggaacatgccccagacctggcagtgcgagctggaggtgtacaaggccacctaccacttcatcttcgcccagaagaacttcttcaccgacctgatccaggactggagcagcgacagcccccccgacatcttcagcttcgtgccctacacctggaacttcaagatcatgttccaccagttcgagatgatctgggccgccaaccagcacaactggatcgactgcagcaccaagcagcaggagaacgtgtacctggccgcctgcggcgagaccctgaacatcgacttcagcctgcccttcaccgacttcgtgcccgccacctgcaacaccaagttcagcctgagaggcgaggacgtggacctgcacctgttcctgcccgactgccaccccagcaagtacagcctgttcatgctggtgaagaactgccaccccaacaagatgatccacgacaccggcatccccgccgagtgccagagcggccagaagaccgtgaagcccaagtggagaaacgtgacccaggagaagagcggctgggtggagtgctggaccgtgcccagcgtgatgctgaccatcgactacacctggcaccccatctacccccagaaggccgacgagcagctgaagcagagcctgagcgagatggaggagaccatgctgagcgtgctgagacccagccagaagaccagcgacagagtggtgagcagccccagcaccagcagcagaccccccatcgaccccagcgagctgccccccgacaagctgcacgtggagatggagctgagccccgacagccagatcaccctgtacggccccctgctgaacgccttcctgtgcatcaaggagaactacttcggcgaggacgacatgtacatggacttcgaggaggtgatcagcagccccgtgctgagcctgagcaccagcagcagcagcggctggaccgccgtgggcatggagaacgacaagaaggagaacgagggcagcgccaagagcatccaccccctggccctgagaccctgggacatcaccgtgctggtgaacctgtacaaggtgcacggcagactgcccgtgcacggcaccaccgacggccccgagtgccccaccgccttcctggagagactgtgcttcgagatgaagaagggcttcagagagaccatgctgcagctgatcctgagccccctgaacgtgttcgtgagcgacaactaccagcagagaccccccgtggacgaggtgctgagagagggccacatcaacctgagcggcctgcagctgagagcccacgccatgttcagcgccgagggcctgcccctgggcagcgacagcctggagtacgcctggctgatcgacgtgcaggccggcagcctgaccgccaaggtgaccgccccccagctggcctgcctgctggagtggggccagaccttcgtgttccacgtggtgtgcagagagtacgagctggagagacccaagagcgtgatcatctgccagcacggcatcgacagaagattctgcgagagcaagctgagctgcatccccggcccctgccccaccagcgacgacctgaagtacaccatgatcagactggccgtggacggcgccgacatctacatcgtggagcacggctgcgccaccaacatcaagatgggcgccatcagagtggccaactgcaacctgcacaaccagagcgtgggcgagggcatcagcgccgccatccaggacttccaggtgagacagtacatcgagcagctgaacaactgcagaatcggcctgcagcccgccgtgctgagaagagcctactggctggaggccggcagcgccaacctgggcctgatcaccgtggacatcgccctggccgccgaccaccacagcaagcacgaggcccagagacacttcctggagacccacgacgccagaaccaagagactgtggttcctgtggcccgacgacatcctgaagaacaagagatgcagaaacaagtgcggctgcctgggcggctgcagattcttcggcggcaccgtgaccggcctggacttcttcaagctggaggagctgacccccagcagcagcagcgccttcagcagcaccagcgccgagagcgacatgtactacggccagagcctgctgcagcccggcgagtggatcatcaccaaggagatccccaagatcatcgacggcaacgtgaacggcatgaagagaaaggagtgggagaacaagagcgtgggcatcgaggtggagagaaagacccagcacctgagcctgcaggtgcccctgagaagccacagcagcagcagcagcagcgaggagaacagcagcagcagcgccgcccagcccctgctggccggcgagaaggagagccccagcagcgtggccgacgaccacctggtgcagaaggagttcctgcacggcaccaagagagacgacggccaggccagcatccccaccgagatcagcggcaacagccccgtgagccccaacacccaggacaagagcgtgggccagagccccctgagaagccccctgaagagacaggccagcgtgtgcagcaccagactgggcagcaccaagagcctgaccgccgccttctacggcgacaagcagcccgtgaccgtgggcgtgcagttcagcagcgacgtgagcagaagcgacgagaacgtgctggacagccccaagcagagaagaagcttcggcagcttcccctacacccccagcgccgacagcaacagcttccaccagtacagaagcatggacagcagcatgagcatggccgacagcgaggcctacttcagcgccgccgaggagttcgagcccatcagcagcgacgagggccccggcacctaccccggcagaaagaagaagaagaagcagacccagcagatcgactacagcagaggcagcatctaccacagcgtggagggccccctgaccggccacggcgagagcatccaggacagcagaaccctgcccttcaagacccaccccagccaggccagcttcgtgagcgccctgggcggcgaggacgacgtgatcgagcacctgtacatcgtggagggcgagaagaccgtggagagcgagcagatcaccccccagcagcccgtgatgaactgctaccagacctacctgacccagttccaggtgatcaactggagcgtgaagcaccccaccaacaagagaaccagcaagagcagcctgcacagacccctggacctggacacccccaccagcgaggagagcagcagcagcttcgagcagctgagcgtgcccaccttcaaggtgatcaagcagggcctgaccgccaacagcctgctggacagaggcatgcagctgagcggcagcaccagcaacaccccctacacccccctggagaagaagctggccgacaacaccgacgacgagaccctgaccgaggagtggaccctggaccagcccgtgagccagaccagaaccaccgccatcgtggaggtgaagggcaccgtggacatcgtgctgacccccctggtggccgaggccctggacagatacatcgaggccatggtgcactgcgccagcaccagacaccccgccgccatcgtggacgacctgcacgccaaggtgctgagagaggccgtgcagaacagcaagaccaccttcagcgagaacctgagcagcaagcaggacatcagaggcaccaagaccgagcagagcaccatcggcaccaccaaccagggccaggcccagaccaacctgaccatgaagcaggacaacgtgaccatcaagggcctgcagaccaacgtgagcatccccaaggtgaacctgtgcctgctgcaggccagcgtggaggagagccccaccaccgcccccagcagaagcgtgacccacgtgagcctggtggccctgtgcttcgacagaatcgccacccaggtgagaatgaacagaggcgtggtggaggagaccagcaacaacgccgagcccggcagaaccagcaacttcgacagatacgtgcacgccaccaagatgcagccccagagcagcggcagcctgagaagcaacgccggcgccgagaagggcaaggagatcgccgccaagctgaacatccacagagtgcacggccagctgagaggcctggacaccaccgacatcggcacctgcgccatcaccgccatccccttcgagaagagcaaggtgctgttcaccctggaggagctggacgagttcaccttcgtggacgagaccgaccagcaggccgtgcccgacgtgaccagaatcggccccagccaggagaagtggggctggatcatgttcgagtgcggcctggagaacctgaccatcaagggcggcagacagagcggcgccgtgctgtacaacagcttcggcatcatgggcaaggccagcgacaccgagagaggcggcgtgctgaccagcaacaacagcagcgacagccccaccggcagcggctacaacaccgacgtgagcgacgacaacctgccctgcgacagaaccagccccagcagcgacctgaacggcaacagcgtgagcgacgagcaggacgagggcgtggagagcgacgacctgaagaaggacctgcccctgatgccccccccccccgacagctgcagcatgaagctgaccatcaaggagatctggttcagcttcgccgcccccaccaacgtgagaagccacacccacgccttcagcagacagctgaacctgctgagcaccgccacccccgccgtgggcgcctggctggtgcccatcgaccagctgaagagcagcctgaacaagctggagaccgagggcaccctgagaatctgcgccgtgatgggctgcatcatgaccgaggccctggagaacaagagcgtgcacttccccctgagaagcaagtacaacagactgaccaaggtggccagattcctgcaggagaaccccagctgcctgctgtgcaacatcctgcaccactacctgcaccaggccaactacagcatcatcgacgacgccaccatgagcgacggcctgcccgccctggtgaccctgaagaagggcctggtggccctggccagacagtggatgaagttcatcgtggtgacccccgccttcaagggcgtgagcctgcacagacccgcccagcccctgaagccccagatcgccatggaccacgagcacgaggacggcctgggcctggacaacggcggcggcctgcagagcgacaccagcgccgacggcgccgagttcgagttcgacgccgccaccgtgagcgagcacaccatgctgctggagggcaccgccaacagacccccccccggcagcagcggccccgtgaccggcgccgagatcatgagaaagctgagcaagacccacacccacagcgacagcgccctgaagatcaagggcatccacccctaccacagcctgagctacaccagcggcgacaccgccaccgacagccccgtgcacgtgggcagagccggcatgcccgtgaaggacagccccagaaaggagagcctgctgagctacctgaccggcagcttccccagcctgcacaacctgctggagggcaccccccagagaagcagcgccgccgtgaagagcagcagcctgaccagaaccggcaacaccgtggccaccgacatgctgagcgagcaccccctgctgagcgagcccagcagcgtgagcttctacaactggatgagcaacgccgtgggcaacagaggcagcgtgctgcaggagagccccgtgaccaagagcggccacaacagcctgcccaccggcgtggcccccaacctgcccaccatccccagcgccagcgacttcaacaccgtgctgagcagcgaccagaacaccctggacggcacccacagccagcacagcaccagccaggacgacgtggccggcgtggaggaggccaaccagggcttccccgccgtgcagctggccgacgcccaggtggtgttcaagcccctgctgagccacaccggcatccagagccaggacaccatgcccttctgctacagaatgtacttcggcgagcacctgagcttcagcggcaccctggactgcctgagagccgacatcgtggacagcgacaccgccaaggagagaaagggcaagagagccagaagacagggccacgtgaacctgccccccctggagttcaagcccgccctgatgctgggcaccttcagcatcagcgccgtggtgatggagaagagcgtgtgcaccccccagaacagcaccagcgccctgagcttccacgacctgagcaagagatactacaacaccttccactgcaacttcaccatcagctgccagagcatcagccagcacgtggacatggccctggtgagactgatccaccagttcagcaccatgatcgacgacatcaaggccacccagaccgacatcaagctgagcagatacaccgccggcagcgccagccccacccccaccttcaagaccagaaagcacagagacttcagaagcagcgacttcagcagaagcagcagaggcagcctgaacggcggcaacagagtgaacaacgccaagaacaagagaaccaacaacgagaacaacaagaaggagagcagaaacaagaacagcctgggcagaagcgagagaagaaccagcaaggtgagcagaaagggcagcaaggacgtggtggaccacatgaccatccacatggacgacagcgacagcatcaccgtgagcgagcagagcgagcccagcgccgagtgctggcagaacatgtacaagctgctgaacttctacagcctgatcagcgaccccaccggcatcctggagaagagcagcgagaccttcggccccgccggcgtgagaagccccaccgagcccacctgcaaggtggtgttcgagaacgagcaggacaacagcagcctgaccaagacccagagaaagagaagcctggtgaccagcgagccccagcacgtgaccctgatcgtgttcggcatcggcatggtgaacagaacccacctggaggccgacatcggcggcctgaccatggagagcgagctgaagagaatccacggcagcttcaccctgaaggagaagatgaaggacgtgctgcaccagaagatgaccgagacctgcgccaccgcccacatcggcggcgtgaacatcgtgctgctggagggcatcacccccaacatccagctggaggacttccccaccagccccaccagcaccgccaagcaggagttcctgaccgtggtgaagtgcagcatcgccaagagccaggccctgtacagcgcccagagaggcctgaagaccaacaacgccgccgtgttcaaggtgggcgccatcagcatcaacatcccccagcaccccgccaccctgcacagcatgatggtgagaagcagccaccagctgagcaagcagatcagcgacctgatcagacagcccagcaccgccccccagcccgtgaaggaggacatcgccacccccctgcccagcgagaagacccccaccagcgtgaaccagacccccgtggagaccaacgagttcccccagctgcccgagggcctggagaagaagcccatcgtgctgaagttcagcgccatgctggacggcatcgccatcggcgccgccctgctgcccagcctgaaggccgagtacaagatgggcagaatgagaagccacggcatgaccggcgcccagaccagattcaccttcgagctgcccaaccacagactgagattcaccagcaaggtgagcgccaccgacatgagcaccatcccccccagcgccagcctgaacctgccccccgtgaccatgagcggcaagtacatcatggaggagcacgacagctacagcgaccaggtgtggagcatcgacgagctgcccagcaagcagggctactacctgcagggcaactacctgagatgcgtggccgaggtgggcagcttcgagcacaacctgaccaccgacctgctgaaccacctggtgttcgtgcagaaggtgttcatgaaggaggtgaacgaggtgatccagaaggtgagcggcggcgagcagcccatccccctgtggaacgagcacgacggcaccgccgacggcgacaagcccaagatcctgctgtacagcctgaacctgcagttcaagggcatccaggtgaccgccaccacccccagcatgagagccgtgagattcgagaccggcctgatcgagctggagctgagcaacagactgcagaccaaggccagccccggcagcagcagctacctgaagctgttcggcaagtgccaggtggacctgaacctggccctgggccagatcgtgaagcaccaggtgtacgaggaggccggcagcgacttccaccaggtggcctacttcaagaccagaatcggcctgagaaacgccctgagagaggagatcagcggcagcagcgacagagaggccgtgctgatcaccctgaacagacccatcgtgtacgcccagcccgtggccttcgacagagccgtgctgttctggctgaactacaaggccgcctacgacaactggaacgagcagagaatggccctgcacaaggacatccacatggccaccaaggaggtggtggacatgctgcccggcatccagcagaccagcgcccaggccttcggcaccctgttcctgcagctgaccgtgaacgacctgggcatctgcctgcccatcaccaacaccgcccagagcaaccacaccggcgacctggacaccggcagcgccctggtgctgaccatcgagagcaccctgatcaccgcctgcagcagcgagagcctggtgagcaagggccacttcaagaacttctgcatcagattcgccgacggcttcgagaccagctgggacgactggaagcccgagatccacggcgacctggtgatgaacgcctgcgtggtgcccgacggcacctacgaggtgtgcagcagaaccaccggccaggccgccgccgagagcagcagcgccggcacctggaccctgaacgtgctgtggaagatgtgcggcatcgacgtgcacatggaccccaacatcggcaagagactgaacgccctgggcaacaccctgaccaccctgaccggcgaggaggacatcgacgacatcgccgacctgaacagcgtgaacatcgccgacctgagcgacgaggacgaggtggacaccatgagccccaccatccacaccgaggccaccgactacagaagacaggccgccagcgccagccagcccggcgagctgagaggcagaaagatcatgaagagaatcgtggacatcagagagctgaacgagcaggccaaggtgatcgacgacctgaagaagctgggcgccagcgagggcaccatcaaccaggagatccagagataccagcagctggagagcgtggccgtgaacgacatcagaagagacgtgagaaagaagctgagaagaagcagcatgagagccgccagcctgaaggacaagtggggcctgagctacaagcccagctacagcagaagcaagagcatcagcgccagcggcagaccccccctgaagagaatggagagagccagcagcagagtgggcgagaccgaggagctgcccgagatcagagtggacgccgccagccccggccccagagtgaccttcaacatccaggacaccttccccgaggagaccgagctggacctgctgagcgtgaccatcgagggccccagccactacagcagcaacagcgagggcagctgcagcgtgttcagcagccccaagacccccggcggcttcagccccggcatccccttccagaccgaggagggcagaagagacgacagcctgagcagcaccagcgaggacagcgagaaggacgagaaggacgaggaccacgagagagagagattctacatctacagaaagcccagccacaccagcagaaagaaggccaccggcttcgccgccgtgcaccagctgttcaccgagagatggcccaccacccccgtgaacagaagcctgagcggcaccgccaccgagagaaacatcgacttcgagctggacatcagagtggagatcgacagcggcaagtgcgtgctgcaccccaccaccctgctgcaggagcacgacgacatcagcctgagaagaagctacgacagaagcagcagaagcctggaccaggacagccccagcaagaagaagaagttccagaccaactacgccagcaccacccacctgatgaccggcaagaaggtgcccagcagcctgcagaccaagcccagcgacctggagaccaccgtgttctacatccccggcgtggacgtgaagctgcactacaacagcaagaccctgaagaccgagagccccaacgccagcagaggcagcagcctgcccagaaccctgagcaaggagagcaagctgtacggcatgaaggacagcgccaccagcccccccagcccccccctgcccagcaccgtgcagagcaagaccaacaccctgctgcccccccagcccccccccatccccgccgccaagggcaagggcagcggcggcgtgaagaccgccaagctgtacgcctgggtggccctgcagagcctgcccgaggagatggtgatcagcccctgcctgctggacttcctggagaaggccctggagaccatccccatcacccccgtggagagaaactacaccgccgtgagcagccaggacgaggacatgggccacttcgagatccccgaccccatggaggagagcaccaccagcctggtgagcagcagcaccagcgcctacagcagcttccccgtggacgtggtggtgtacgtgagagtgcagcccagccagatcaagttcagctgcctgcccgtgagcagagtggagtgcatgctgaagctgcccagcctggacctggtgttcagcagcaacagaggcgagctggagaccctgggcaccacctaccccgccgagaccctgagccccggcggcaacgccacccagagcggcaccaagaccagcgccagcaagaccggcatccccggcagcagcggcctgggcagccccctgggcagaagcagacacagcagcagccagagcgacctgaccagcagcagcagcagcagcagcggcctgagcttcaccgcctgcatgagcgacttcagcctgtacgtgttccacccctacggcgccggcaagcagaagaccgccgtgagcggcctgacccccggcagcggcggcctgggcaacgtggacgaggagcccaccagcgtgaccggcagaaaggacagcctgagcatcaacctggagttcgtgaaggtgagcctgagcagaatcagaagaagcggcggcgccagcttcttcgagagccagagcgtgagcaagagcgccagcaagatggacaccaccctgatcaacatcagcgccgtgtgcgacatcggcagcgccagcttcaagtacgacatgagaagactgagcgagatcctggccttccccagagcctggtacagaagaagcatcgccagaagactgttcctgggcgaccagaccatcaacctgcccaccagcggccccggcacccccgacagcatcgagggcgtgagccagcacctgagccccgagagcagcagaaaggcctactgcaagacctgggagcagcccagccagagcgccagcttcacccacatgccccagagccccaacgtgttcaacgagcacatgaccaacagcaccatgagccccggcaccgtgggccagagcctgaagagccccgccagcatcagaagcagaagcgtgagcgacagcagcgtgcccagaagagacagcctgagcaagaccagcacccccttcaacaagagcaacaaggccgccagccagcagggcaccccctgggagaccctggtggtgttcgccatcaacctgaagcagctgaacgtgcagatgaacatgagcaacgtgatgggcaacaccacctggaccaccagcggcctgaagagccagggcagactgagcgtgggcagcaacagagacagagagatcagcatgagcgtgggcctgggcagaagccagctggacagcaagggcggcgtggtgggcggcaccatcgacgtgaacgccctggagatggtggcccacatcagcgagcaccccaaccagcagcccagccacaagatccagatcaccatgggcagcaccgaggccagagtggactacatgggcagcagcatcctgatgggcatcttcagcaacgccgacctgaagctgcaggacgagtggaaggtgaacctgtacaacaccctggacagcagcatcaccgacaagagcgagatcttcgtgcacggcgacctgaagtgggacatcttccaggtgatgatcagcagaagcaccacccccgacctgatcaagatcggcatgaagctgcaggagttcttcacccagcagttcgacaccagcaagagagccctgagcacctggggccccgtgccctacctgccccccaagaccatgaccagcaacctggagaagagcagccaggagcagctgctggacgccgcccaccacagacactggcccggcgtgctgaaggtggtgagcggctgccacatcagcctgttccagatccccctgcccgaggacggcatgcagttcggcggcagcatgagcctgcacggcaaccacatgaccctggcctgcttccacggccccaacttcagaagcaagagctgggccctgttccacctggaggagcccaacatcgccttctggaccgaggcccagaagatctgggaggacggcagcagcgaccacagcacctacatcgtgcagaccctggacttccacctgggccacaacaccatggtgaccaagccctgcggcgccctggagagccccatggccaccatcaccaagatcaccagaagaagacacgagaaccccccccacggcgtggccagcgtgaaggagtggttcaactacgtgaccgccaccagaaacgaggagctgaacctgctgagaaacgtggacgccaacaacaccgagaacagcaccaccgtgaagaacagcagcctgctgagcggcttcagaggcggcagcagctacaaccacgagaccgagaccatcttcgccctgcccagaatgcagctggacttcaagagcatccacgtgcaggagccccaggagcccagcctgcaggacgccagcctgaagcccaaggtggagtgcagcgtggtgaccgagttcaccgaccacatctgcgtgaccatggacgccgagctgatcatgttcctgcacgacctggtgagcgcctacctgaaggagaaggagaaggccatcttcccccccagaatcctgagcaccagacccggccagaagagccccatcatcatccacgacgacaacagcagcgacaaggacagagaggacagcatcacctacaccaccgtggactggagagacttcatgtgcaacacctggcacctggagcccaccctgagactgatcagctggaccggcagaaagatcgaccccgtgggcgtggactacatcctgcagaagctgggcttccaccacgccagaaccaccatccccaagtggctgcagagaggcgtgatggaccccctggacaaggtgctgagcgtgctgatcaagaagctgggcaccgccctgcaggacgagaaggagaagaagggcaaggacaaggaggagcactag

SEQ ID NO: 95032 - DNA, 1287 bp, Artificial Sequence
  Description of Artificial Sequence: Synthetic coding sequence
atgggcggcctgttcagcagatggagaaccaagcccagcaccgtggaggtgctggagagcatcgacaaggagatccaggccctggaggagttcagagagaagaaccagagactgcagaagctgtgggtgggcagactgatcctgtacagcagcgtgctgtacctgttcacctgcctgatcgtgtacctgtggtacctgcccgacgagttcaccgccagactggccatgaccctgcccttcttcgccttccccctgatcatctggagcatcagaaccgtgatcatcttcttcttcagcaagagaaccgagagaaacaacgaggccctggacgacctgaagagccagagaaagaagatcctggaggaggtgatggagaaggagacctacaagaccgccaagctgatcctggagagattcgaccccgacagcaagaaggccaaggagtgcgagccccccagcgccggcgccgccgtgaccgccagacccggccaggagatcagacagagaaccgccgcccagagaaacctgagccccacccccgccagccccaaccagggcccccccccccaggtgcccgtgagccccggcccccccaaggacagcagcgcccccggcggcccccccgagagaaccgtgacccccgccctgagcagcaacgtgctgcccagacacctgggcagccccgccaccagcgtgcccggcatgggcctgcacccccccggcccccccctggccagacccatcctgcccagagagagaggcgccctggacagaatcgtggagtacctggtgggcgacggcccccagaacagatacgccctgatctgccagcagtgcttcagccacaacggcatggccctgaaggaggagttcgagtacatcgccttcagatgcgcctactgcttcttcctgaaccccgccagaaagaccagaccccaggcccccagactgcccgagttcagcttcgagaagagacaggtggtggagggcagcagcagcgtgggccccctgcccagcggcagcgtgctgagcagcgacaaccagttcaacgaggagagcctggagcacgacgtgctggacgacaacaccgagcagaccgacgacaagatccccgccaccgagcagaccaaccaggtgatcgagaaggccagcgacagcgaggagcccgaggagaagcaggagaccgagaacgaggaggccagcgtgatcgagaccaacagcaccgtgcccggcgccgacagcatccccgaccccgagctgagcggcgagagcctgaccgccgagtag

SEQ ID NO: 95033 - DNA, 2718 bp, Artificial Sequence
  Description of Artificial Sequence: Synthetic coding sequence
atggacagcaccgcctgcctgaagagcctgctgctgaccgtgagccagtacaaggccgtgaagagcgaggccaacgccacccagctgctgagacacctggaggtgatcagcggccagaagctgaccagactgttcaccagcaaccagatcctgaccagcgagtgcctgagctgcctggtggagctgctggaggaccccaacatcagcgccagcctgatcctgagcatcatcggcctgctgagccagctggccgtggacatcgagaccagagactgcctgcagaacacctacaacctgaacagcgtgctggccggcgtggtgtgcagaagcagccacaccgacagcgtgttcctgcagtgcatccagctgctgcagaagctgacctacaacgtgaagatcttctacagcggcgccaacatcgacgagctgatcaccttcctgatcgaccacatccagagcagcgaggacgagctgaagatgccctgcctgggcctgctggccaacctgtgcagacacaacctgagcgtgcagacccacatcaagaccctgagcaacgtgaagagcttctacagaaccctgatcaccctgctggcccacagcagcctgaccgtggtggtgttcgccctgagcatcctgagcagcctgaccctgaacgaggaggtgggcgagaagctgttccacgccagaaacatccaccagaccttccagctgatcttcaacatcctgatcaacggcgacggcaccctgaccagaaagtacagcgtggacctgctgatggacctgctgaagaaccccaagatcgccgactacctgaccagatacgagcacttcagcagctgcctgcaccaggtgctgggcctgctgaacggcaaggaccccgacagcagcagcaaggtgctggagctgctgctggccttctgcagcgtgacccagctgagacacatgctgacccagatgatgttcgagcagagcccccccggcagcgccaccctgggcagccacaccaagtgcctggagcccaccgtggccctgctgagatggctgagccagcccctggacggcagcgagaactgcagcgtgctggccctggagctgttcaaggagatcttcgaggacgtgatcgacgccgccaactgcagcagcgccgacagattcgtgaccctgctgctgcccaccatcctggaccagctgcagttcaccgagcagaacctggacgaggccctgaccagaaagaagtgcgagagaatcgccaaggccatcgaggtgctgctgaccctgtgcggcgacgacaccctgaagatgcacatcgccaagatcctgaccaccgtgaagtgcaccaccctgatcgagcagcagttcacctacggcaagatcgacctgggcttcggcaccaaggtggccgacagcgagctgtgcaagctggccgccgacgtgatcctgaagaccctggacctgatcaacaagctgaagcccctggtgcccggcatggaggtgagcttctacaagatcctgcaggaccccagactgatcacccccctggccttcgccctgaccagcgacaacagagagcaggtgcagagcggcctgagaatcctgctggaggccgcccccctgcccgacttccccgccctggtgctgggcgagagcatcgccgccaacaacgcctacagacagcaggagaccgagcacatccccagaaagatgccctggcagagcagcaaccacagcttccccaccagcatcaagtgcctgaccccccacctgaaggacggcgtgcccggcctgaacatcgaggagctgatcgagaagctgcagagcggcatggtggtgaaggaccagatctgcgacgtgagaatcagcgacatcatggacgtgtacgagatgaagctgagcaccctggccagcaaggagagcagactgcaggacctgctggagaccaaggccctggccctggcccaggccgacagactgatcgcccagcacagatgccagagaacccaggccgagaccgaggccagaaccctggccagcatgctgagagaggtggagagaaagaacgaggagctgagcgtgctgctgaaggcccagcaggtggagagcgagagagcccagagcgacatcgagcacctgttccagcacaacagaaagctggagagcgtggccgaggagcacgagatcctgaccaagagctacatggagctgctgcagagaaacgagagcaccgagaagaagaacaaggacctgcagatcacctgcgacagcctgaacaagcagatcgagaccgtgaagaagctgaacgagagcctgaaggagcagaacgagaagagcatcgcccagctgatcgagaaggaggagcagagaaaggaggtgcagaaccagctggtggacagagagcacaagctggccaacctgcaccagaagaccaaggtgcaggaggagaagatcaagaccctgcagaaggagagagaggacaaggaggagaccatcgacatcctgagaaaggagctgagcagaaccgagcagatcagaaaggagctgagcatcaaggccagcagcctggaggtgcagaaggcccagctggagggcagactggaggagaaggagagcctggtgaagctgcagcaggaggagctgaacaagcacagccacatgatcgccatgatccacagcctgagcggcggcaagatcaaccccgagaccgtgaacctgagcatctag

SEQ ID NO: 95034 - DNA, 2370 bp, Artificial Sequence
  Description of Artificial Sequence: Synthetic coding sequence
atgctggagggcaactaccaggtgatgctgaagagcggcaccaacatcctgtactggagaaccaccggcatcctgatgggcagcaaggccgtgaagcccgtgctggtgaagaacatcaccatcgagggcgtggcctacaccagcgagtgcttcccctgcaagcccggcaccttcagcaacaagcccggcagcttcaactgccaggtgtgccccagaaacacctacagcgagaagggcgccaaggagtgcatcagatgcaaggacgacagccagttcagcgaggagggcagcagcgagtgcaccgagagacccccctgcaccaccaaggactacttccagatccacaccccctgcgacgaggagggcaagacccagatcatgtacaagtggatcgagcccaagatctgcagagaggacctgaccgacgccatcagactgccccccagcggcgagaagaaggactgccccccctgcaaccccggcttctacaacaacggcagcagcagctgccacccctgcccccccggcaccttcagcgacggcaccaaggagtgcagaccctgccccgccggcaccgagcccgccctgggcttcgagtacaagtggtggaacgtgctgcccggcaacatgaagaccagctgcttcaacgtgggcaacagcaagtgcgacggcatgaacggctgggaggtggccggcgaccacatccagagcggcgccggcggcagcgacaacgactacctgatcctgaacctgcacatccccggcttcaagccccccaccagcatgaccggcgccaccggcagcgagctgggcagaatcaccttcgtgttcgagaccctgtgcagcgccgactgcgtgctgtacttcatggtggacatcaacagaaagagcaccaacgtggtggagagctggggcggcaccaaggagaagcaggcctacacccacatcatcttcaagaacgccaccttcaccttcacctgggccttccagagaaccaaccagggccaggacaacagaagattcatcaacgacatggtgaagatctacagcatcaccgccaccaacgccgtggacggcgtggccagcagctgcagagcctgcgccctgggcagcgagcagagcggcagcagctgcgtgccctgcccccccggccactacatcgagaaggagaccaaccagtgcaaggagtgcccccccgacacctacctgagcatccaccaggtgtacggcaaggaggcctgcatcccctgcggccccggcagcaagaacaaccaggaccacagcgtgtgctacagcgactgcttcttctaccacgagaaggagaaccagagcctgcactacgacttcagcaacctgagcagcgtgggcagcctgatgaacggccccagcttcaccagcaagggcaccaagtacttccacttcttcaacatcagcctgtgcggccacgagggcaagaagatggccctgtgcaccaacaacatcaccgacttcaccgtgaaggagatcgtggccggcagcgacgactacaccaacctggtgggcgccttcgtgtgccagagcaccatcatccccagcgagagcaagggcttcagagccgccctgagcagccagagcatcatcctggccgacaccttcatcggcgtgaccgtggagaccaccctgaagaacatcaacatcaaggaggacatgttccccgtgcccaccagccagatccccgacgtgcacttcttctacaagagcagcaccgccaccaccagctgcatcaacggcagaagcaccgccgtgaagatgagatgcaaccccaccaagagcggcgccggcgtgatcagcgtgcccagcaagtgccccgccggcacctgcgacggctgcaccttctacttcctgtgggagagcgccgaggcctgccccctgtgcaccgagcacgacttccacgagatcgagggcgcctgcaagagaggcttccaggagaccctgtacgtgtggaacgagcccaagtggtgcatcaagggcatcagcctgcccgagaagaagctggccacctgcgagaccgtggacttctggctgaaggtgggcgccggcgtgggcgccttcaccgccgtgctgctggtggccctgacctgctacttctggaagaagaaccagaagctggagtacaagtacagcaagctggtgatgaccaccaacagcaaggagtgcgagctgcccgccgccgacagctgcgccatcatggagggcgaggacaacgaggaggaggtggtgtacagcaacaagcagagcctgctgggcaagctgaagagcctggccaccaaggagaaggaggaccacttcgagagcgtgcagctgaagaccagcagaagccccaacatctag

SEQ ID NO: 95035 - DNA, 336 bp, Artificial Sequence
  Description of Artificial Sequence: Synthetic coding sequence
atggtgagaaccaaggccgacagcgtgcccggcacctacagaaaggtggtggccgccagagcccccagaaaggtgctgggcagcagcaccagcgccaccaacagcaccagcgtgagcagcagaaaggccgagaacaagtacgccggcggcaaccccgtgtgcgtgagacccacccccaagtggcagaagggcatcggcgagttcttcagactgagccccaaggacagcgagaaggagaaccagatccccgaggaggccggcagcagcggcctgggcaaggccaagagaaaggcctgccccctgcagcccgaccacaccaacgacgagaaggagtag

SEQ ID NO: 95036 - DNA, 2772 bp, Artificial Sequence
  Description of Artificial Sequence: Synthetic coding sequence
atgagccagttcaagagacagagaatcaaccccctgcccggcggcagaaacttcagcggcaccgccagcaccagcctgctgggccccccccccggcctgctgaccccccccgtggccaccgagctgagccagaacgccagacacctgcagggcggcgagaagcagagagtgttcaccggcatcgtgaccagcctgcacgactacttcggcgtggtggacgaggaggtgttcttccagctgagcgtggtgaagggcagactgccccagctgggcgagaaggtgctggtgaaggccgcctacaaccccggccaggccgtgccctggaacgccgtgaaggtgcagaccctgagcaaccagcccctgctgaagagccccgccccccccctgctgcacgtggccgccctgggccagaagcagggcatcctgggcgcccagccccagctgatcttccagccccacagaatcccccccctgttcccccagaagcccctgagcctgttccagaccagccacaccctgcacctgagccacctgaacagattccccgccagaggcccccacggcagactggaccagggcagaagcgacgactacgacagcaagaagagaaagcagagagccggcggcgagccctggggcgccaagaagcccagacacgacctgcccccctacagagtgcacctgaccccctacaccgtggacagccccatctgcgacttcctggagctgcagagaagatacagaagcctgctggtgcccagcgacttcctgagcgtgcacctgagctggctgagcgccttccccctgagccagcccttcagcctgcaccaccccagcagaatccaggtgagcagcgagaaggaggccgcccccgacgccggcgccgagcccatcaccgccgacagcgaccccgcctacagcagcaaggtgctgctgctgagcagccccggcctggaggagctgtacagatgctgcatgctgttcgtggacgacatggccgagcccagagagacccccgagcaccccctgaagcagatcaagttcctgctgggcagaaaggaggaggaggccgtgctggtgggcggcgagtggagccccagcctggacggcctggacccccaggccgacccccaggtgctggtgagaaccgccatcagatgcgcccaggcccagaccggcatcgacctgagcggctgcaccaagtggtggagattcgccgagttccagtacctgcagcccggcccccccagaagactgcagaccgtggtggtgtacctgcccgacgtgtggaccatcatgcccaccctggaggagtgggaggccctgtgccagcagaaggccgccgaggccgccccccccacccaggaggcccagggcgagaccgagcccaccgagcaggcccccgacgccctggagcaggccgccgacaccagcagaagaaacgccgagacccccgaggccaccacccagcaggagaccgacaccgacctgcccgaggccccccccccccccctggagcccgccgtgatcgccagacccggctgcgtgaacctgagcctgcacggcatcgtggaggacagaagacccaaggagagaatcagcttcgaggtgatggtgctggccgagctgttcctggagatgctgcagagagacttcggctacagagtgtacaagatgctgctgagcctgcccgagaaggtggtgagcccccccgagcccgagaaggaggaggccgccaaggaggaggccaccaaggaggaggaggccatcaaggaggaggtggtgaaggagcccaaggacgaggcccagaacgagggccccgccaccgagagcgaggcccccctgaaggaggacggcctgctgcccaagcccctgagcagcggcggcgaggaggaggagaagcccagaggcgaggccagcgaggacctgtgcgagatggccctggaccccgagctgctgctgctgagagacgacggcgaggaggagttcgccggcgccaagctggaggacagcgaggtgagaagcgtggccagcaaccagagcgagatggagttcagcagcctgcaggacatgcccaaggagctggaccccagcgccgtgctgcccctggactgcctgctggccttcgtgttcttcgacgccaactggtgcggctacctgcacagaagagacctggagagaatcctgctgaccctgggcatcagactgagcgccgagcaggccaagcagctggtgagcagagtggtgacccagaacatctgccagtacagaagcctgcagtacagcagacaggagggcctggacggcggcctgcccgaggaggtgctgttcggcaacctggacctgctgcccccccccggcaagagcaccaagcccggcgccgcccccaccgagcacaaggccctggtgagccacaacggcagcctgatcaacgtgggcagcctgctgcagagagccgagcagcaggacagcggcagactgtacctggagaacaagatccacaccctggagctgaagctggaggagagccacaacagattcagcgccaccgaggtgaccaacaagaccctggccgccgagatgcaggagctgagagtgagactggccgaggccgaggagaccgccagaaccgccgagagacagaagagccagctgcagagactgctgcaggagctgagaagaagactgacccccctgcagctggagatccagagagtggtggagaaggccgacagctgggtggagaaggaggagcccgcccccagcaactag

SEQ ID NO: 95037 - DNA, 3480 bp, Artificial Sequence
  Description of Artificial Sequence: Synthetic coding sequence
atgctggacttcctggccgagaacaacctgtgcggccaggccatcctgagaatcgtgagctgcggcaacgccatcatcgccgagctgctgagactgagcgagttcatccccgccgtgttcagactgaaggacagagccgaccagcagaagtacggcgacatcatcttcgacttcagctacttcaagggccccgagctgtgggagagcaagctggacgccaagcccgagctgcaggacctggacgaggagttcagagagaacaacatcgagatcgtgaccagattctacctggccttccagagcgtgcacaagtacatcgtggacctgaacagatacctggacgacctgaacgagggcgtgtacatccagcagaccctggagaccgtgctgctgaacgaggacggcaagcagctgctgtgcgaggccctgtacctgtacggcgtgatgctgctggtgatcgaccagaagatcgagggcgaggtgagagagagaatgctggtgagctactacagatacagcgccgccagaagcagcgccgacagcaacatggacgacatctgcaagctgctgagaagcaccggctacagcagccagcccggcgccaagagacccagcaactaccccgagagctacttccagagagtgcccatcaacgagagcttcatcagcatggtgatcggcagactgagaagcgacgacatctacaaccaggtgagcgcctaccccctgcccgagcacagaagcaccgccctggccaaccaggccgccatgctgtacgtgatcctgtacttcgagcccagcatcctgcacacccaccaggccaagatgagagagatcgtggacaagtacttccccgacaactgggtgatcagcatctacatgggcatcaccgtgaacctggtggacgcctgggagccctacaaggccgccaagaccgccctgaacaacaccctggacctgagcaacgtgagagagcaggccagcagatacgccaccgtgagcgagagagtgcacgcccaggtgcagcagttcctgaaggagggctacctgagagaggagatggtgctggacaacatccccaagctgctgaactgcctgagagactgcaacgtggccatcagatggctgatgctgcacaccgccgacagcgcctgcgaccccaacaacaagagactgagacagatcaaggaccagatcctgaccgacagcagatacaaccccagaatcctgttccagctgctgctggacaccgcccagttcgagttcatcctgaaggagatgttcaagcagatgctgagcgagaagcagaccaagtgggagcactacaagaaggagggcagcgagagaatgaccgagctggccgacgtgttcagcggcgtgaagcccctgaccagagtggagaagaacgagaacctgcaggcctggttcagagagatcagcaagcagatcctgagcctgaactacgacgacagcaccgccgccggcagaaagaccgtgcagctgatccaggccctggaggaggtgcaggagttccaccagctggagagcaacctgcaggtgtgccagttcctggccgacaccagaaagttcctgcaccagatgatcagaaccatcaacatcaaggaggaggtgctgatcaccatgcagatcgtgggcgacctgagcttcgcctggcagctgatcgacagcttcaccagcatcatgcaggagagcatcagagtgaaccccagcatggtgaccaagctgagagccaccttcctgaagctggccagcgccctggacctgcccctgctgagaatcaaccaggccaacagccccgacctgctgagcgtgagccagtactacagcggcgagctggtgagctacgtgagaaaggtgctgcagatcatccccgagagcatgttcaccagcctgctgaagatcatcaagctgcagacccacgacatcatcgaggtgcccaccagactggacaaggacaagctgagagactacgcccagctgggccccagatacgaggtggccaagctgacccacgccatcagcatcttcaccgagggcatcctgatgatgaagaccaccctggtgggcatcatcaaggtggaccccaagcagctgctggaggacggcatcagaaaggagctggtgaagagagtggccttcgccctgcacagaggcctgatcttcaaccccagagccaagcccagcgagctgatgcccaagctgaaggagctgggcgccaccatggacggcttccacagaagcttcgagtacatccaggactacgtgaacatctacggcctgaagatctggcaggaggaggtgagcagaatcatcaactacaacgtggagcaggagtgcaacaacttcctgagaaccaagatccaggactggcagagcatgtaccagagcacccacatccccatccccaagttcacccccgtggacgagagcgtgaccttcatcggcagactgtgcagagagatcctgagaatcaccgaccccaagatgacctgccacatcgaccagctgaacacctggtacgacatgaagacccaccaggaggtgaccagcagcagactgttcagcgagatccagaccaccctgggcaccttcggcctgaacggcctggacagactgctgtgcttcatgatcgtgaaggagctgcagaacttcctgagcatgttccagaagatcatcctgagagacagaaccgtgcaggacaccctgaagaccctgatgaacgccgtgagccccctgaagagcatcgtggccaacagcaacaagatctacttcagcgccatcgccaagacccagaagatctggaccgcctacctggaggccatcatgaaggtgggccagatgcagatcctgagacagcagatcgccaacgagctgaactacagctgcagattcgacagcaagcacctggccgccgccctggagaacctgaacaaggccctgctggccgacatcgaggcccactaccaggaccccagcctgccctaccccaaggaggacaacaccctgctgtacgagatcaccgcctacctggaggccgccggcatccacaaccccctgaacaagatctacatcaccaccaagagactgccctacttccccatcgtgaacttcctgttcctgatcgcccagctgcccaagctgcagtacaacaagaacctgggcatggtgtgcagaaagcccaccgaccccgtggactggccccccctggtgctgggcctgctgaccctgctgaagcagttccacagcagatacaccgagcagttcctggccctgatcggccagttcatctgcagcaccgtggagcagtgcaccagccagaagatccccgagatccccgccgacgtggtgggcgccctgctgttcctggaggactacgtgagatacaccaagctgcccagaagagtggccgaggcccacgtgcccaacttcatcttcgacgagttcagaaccgtgctgtag

SEQ ID NO: 95038 - DNA, 2424 bp, Artificial Sequence
  Description of Artificial Sequence: Synthetic coding sequence
atgttcagcgccggcgccgagagcctgctgcaccaggccagagagatccaggacgaggagctgaagaagttctgcagcagaatctgcaagctgctgcaggccgaggacctgggccccgacaccctggacagcctgcagagactgttcctgatcatcagcgccaccaagtacagcagaagactggagaagacctgcgtggacctgctgcaggccaccctgggcctgcccgcctgccccgagcagctgcaggtgctgtgcgccgccatcctgagagagatgagccccagcgacagcctgagcctggcctgggaccacacccagaacagcagacagctgagcctggtggccagcgtgctgctggcccagggcgacagaaacgaggaggtgagagccgtgggccagggcgtgctgagagccctggagagcagacagcccgagggccccagcctgagacacctgctgcccgtgatggccaaggtggtggtgctgagccccggcaccctgcaggaggaccaggccaccctgctgagcaagagactggtggactggctgagatacgccagcctgcagcagggcctgccccacagcggcggcttcttcagcacccccagagccagacagcccggccccgtgaccgaggtggacggcgccgtggccaccgacttcttcaccgtgctgagcagcggccacagattcaccgacgaccagtggctgaacgtgcaggccttcagcatgctgagagcctggctgctgcacagcggccccgagggccccggcaccctggacaccgacgacagaagcgagcaggagggcagcaccctgagcgtgatcagcgccaccagcagcgccggcagactgctgccccccagagagagactgagagaggtggccttcgagtactgccagagactgatcgagcagagcaacagaagagccctgagaaagggcgacagcgacctgcagaaggcctgcctggtggaggccgtgctggtgctggacgtgctgtgcagacaggaccccagcttcctgtacagaagcctgagctgcctgaaggccctgcacggcagagtgagaggcgaccccgccagcgtgagagtgctgctgcccctggcccacttcttcctgagccacggcgaggccgccgccgtggacagcgaggccgtgtaccagcacctgttcaccagaatccccgtggagcagttccacagccccatgctggccttcgagttcatccagttctgcagagacaacctgcacctgttcagcggccacctgagcaccctgagactgagcttccccaacctgttcaagttcctggcctggaacagcccccccctgaccagcgagttcgtggccctgctgcccgccctggtggacgccggcaccgccctggagatgctgcacgccctgctggacctgccctgcctgaccgccgtgctggacctgcagctgagaagcgcccccgccgccagcgagagacccctgtgggacaccagcctgagagcccccagctgcctggaggccttcagagacccccagttccagggcctgttccagtacctgctgagacccaaggccagcggcgccaccgagagactggcccccctgcaccagctgctgcagcccatggccggctgcgccagagtggcccagtgcgcccaggccgtgcccaccctgctgcaggccttcttcagcgccgtgacccaggtggccgacggcagcctgatcaaccagctggccctgctgctgctgggcagaagcgacagcctgtaccccgcccccggctacgccgccggcgtgcacagcgtgctgagcagccagttcctggccctgtgcaccctgaagcccagcctggtggtggagctggccagagacctgctggagttcctgggcagcgtgaacggcctgtgcagcagagccagcctggtgaccagcgtggtgtgggccatcggcgagtacctgagcgtgacctacgacagaagatgcaccgtggagcagatcaacaagttcttcgaggccctggaggccctgctgttcgaggtgacccagtgcagacccagcgccgccctgcccagatgccccccccaggtggtgaccgtgctgatgaccaccctgaccaagctggccagcagaagccaggacctgatccccagagccagcctgctgctgagcaagatgagaaccctggcccacagccccgccaccagcagcacccacagcgaggagggcgccgaggccatcagaaccagagccaccgagctgctgaccctgctgaagatgcccagcgtggcccagttcgtgctgacccccagcaccgaggtgtgcagccccagataccacagagacgccaacaccgccctgcccctggccctgagaaccgtgagcagactggtggagagagaggccggcctgatgcccggctag

SEQ ID NO: 95039 - DNA, 4086 bp, Artificial Sequence; identical to SEQ ID NO: 80223
  Description of Artificial Sequence: Synthetic coding sequence

SEQ ID NO: 95040 - DNA, 1866 bp, Artificial Sequence
  Description of Artificial Sequence: Synthetic coding sequence
atggccaacgtgccctgggccgaggtgtgcgagaagttccaggccgccctggccctgagcagagtggagctgcacaagaaccccgagaaggagccctacaagagcaagtacagcgccagagccctgctggaggaggtgaaggccctgctgggccccgcccccgaggacgaggacgagagacccgaggccgaggacggccccggcgccggcgaccacgccctgggcctgcccgccgaggtggtggagcccgagggccccgtggcccagagagccgtgagactggccgtgatcgagttccacctgggcgtgaaccacatcgacaccgaggagctgagcgccggcgaggagcacctggtgaagtgcctgagactgctgagaagatacagactgagccacgactgcatcagcctgtgcatccaggcccagaacaacctgggcatcctgtggagcgagagagaggagatcgagaccgcccaggcctacctggagagcagcgaggccctgtacaaccagtacatgaaggaggtgggcagcccccccctggaccccaccgagagattcctgcccgaggaggagaagctgaccgagcaggagagaagcaagagattcgagaaggtgtacacccacaacctgtactacctggcccaggtgtaccagcacctggagatgttcgagaaggccgcccactactgccacagcaccctgaagagacagctggagcacaacgcctaccaccccatcgagtgggccatcaacgccgccaccctgagccagttctacatcaacaagctgtgcttcatggaggccagacactgcctgagcgccgccaacgtgatcttcggccagaccggcaagatcagcgccaccgaggacacccccgaggccgagggcgaggtgcccgagctgtaccaccagagaaagggcgagatcgccagatgctggatcaagtactgcctgaccctgatgcagaacgcccagctgagcatgcaggacaacatcggcgagctggacctggacaagcagagcgagctgagagccctgagaaagaaggagctggacgaggaggagagcatcagaaagaaggccgtgcagttcggcaccggcgagctgtgcgacgccatcagcgccgtggaggagaaggtgagctacctgagacccctggacttcgaggaggccagagagctgttcctgctgggccagcactacgtgttcgaggccaaggagttcttccagatcgacggctacgtgaccgaccacatcgaggtggtgcaggaccacagcgccctgttcaaggtgctggccttcttcgagaccgacatggagagaagatgcaagatgcacaagagaagaatcgccatgctggagcccctgaccgtggacctgaacccccagtactacctgctggtgaacagacagatccagttcgagatcgcccacgcctactacgacatgatggacctgaaggtggccatcgccgacagactgagagaccccgacagccacatcgtgaagaagatcaacaacctgaacaagagcgccctgaagtactaccagctgttcctggacagcctgagagaccccaacaaggtgttccccgagcacatcggcgaggacgtgctgagacccgccatgctggccaagttcagagtggccagactgtacggcaagatcatcaccgccgaccccaagaaggagctggagaacctggccaccagcctggagcactacaagttcatcgtggactactgcgagaagcaccccgaggccgcccaggagatcgaggtggagctggagctgagcaaggagatggtgagcctgctgcccaccaagatggagagattcagaaccaagatggccctgacctag

SEQ ID NO: 95041 - DNA, 4551 bp, Artificial Sequence; identical to SEQ ID NO: 95027
  Description of Artificial Sequence: Synthetic coding sequence

SEQ ID NO: 95042 - DNA, 4080 bp, Artificial Sequence
  Description of Artificial Sequence: Synthetic coding sequence
atgtacagcgtggaggacctgctgatcagccacggctacaagctgagcagagacccccccgccagcagagaggacaaccccaagggcagacaggccgccagaaccggcaccagagccggccagggcctgcagaacggccacgaggacggccccgccgccctggcccacagaaagaccagcgccggcaagggccacgtgagcgacagcgagagcagaagaagcacccccagaggccacggcgagccccagagcaccagcgccagcagaaccagcgaggccggcttctgcaaccagccccccagcgcctggagcagccacccccccaccggcaacgaccaggcctacagaagaagaggcagacaggaggccagaagccagaagcccagagagcacgagaacctggaggccagaggcatggcccaggcccacagcctgcccgtgcacgtgagagagggcccctgggaggtgggcggcagaagcgagcacgtgatgaagaagcccgtgtgggaggaggagctgagaatgagcggccccgccaagtggcagaacgtgagcctggagagctggaaccagcccagaaagctgggcagacagatgagcgacggcgacggcgagagactgttccaggacctgtaccccttcatccagggcgagcacgtgctgaacagccagaacaagggcaagagcagaagcctgcccagagtgctgagccccgagagcctgagctgcaccgagatccccatccccctgaacgagagacacagccccaagatgcccccctacccccccacctgcgcccccaacctggacagcaccagaaacagcgagaagagcggctgcagcgcccccttccccagacccaagttcggcagacccctgaagccccccagctacagcagccaccagcagagcagaggcggcgccgacagcagcgacagccaggacagccagcagatggacgcctacgtgcccagacacgagctgtgcctgagcgaccccggcctggagccccccgtgtacgtgcccccccccagctacagaagccccccccagaacatccccaacccctacctggaggacaccgtgcccatcaacgtgtgcggcggccacagccagcagcagagccccaccgagaaggccggcgccagcggccagccccccagcggcccccccggcaccggcaacgagtacggcgtgagccccagactgccccagggcctgcccgcccaccccagacccgtgaccgcctacgacggcttcgtgcagtacatccccttcgacgaccccagactgagacacttcaagctggcccagccccagggcttctgcgaggacatcaagctggacgacaagagctacaacagcagccccgtgaccgcccaggagcccgcccacggcggcatgcagcccgacggcgccatctggaacccccagagcctgatcccccccagcggcgacgagagaggcctggtgctggccgacagcagccccagatggctgtggggccagccccccggcgacggcgagaacagcggcctgcccaaccagagagacagatgcgtggccagaggccagtggcccgacgtgagaggcagccagcacggccacaccggcagacaggtgagcagcccctacagccagggcgagagcacctgcgagacccagaccaagctgaagaagttccagaccggcaccagaaccaagaagagcagcaagaagaagatgaacgagaccatcttctgcctggtgagcatccccgtgaagagcgagagccacctgcccgacagagacatggacaacaacgacctgaagcccagcgccgaccagaagaacggcagcgacaagagccccgccctgcaggagcagagcctgctgagcatgagcagcaccgacctggagctgcaggccctgaccggcagcatgggcggcagaaccgagttccagaagcaggacctgggcgagcccgaggaggacagacagaccaacgacctgagcttcatccacctgaccaagcacagagagctgaagcacagcggcagctggcccggccacagatacagagaccagcagacccagaccagcttcagcgaggagccccagagcagccagctgctgcccggcgccaagctgggcggccccagcagagccgccctgagccccaagtgcagcgaccccgccgccagcgaggcccagacccacaccgccttccccaccggcgaccacaagcagagacccagcgccagaaacctgaagggccacagaagcctgagccccagcagcaacagcgccttcagcagaaccagcctgagcgtggaccaggcccccacccccaaggccggcagaagccagccctgcgtggacgtgcacggcctgggcgcccaccccggccccaagagagaggtggtgaagggcgagcccaccggcccctgcaacagcaagcagctgttcggccagttcctgctgaagcccgtgagcagaagaccctgggacctgatcagccagctggagagcttcaacaaggagctgcaggaggaggaggagagcagcagcagcagcagcagcagcagcagcagcagcgaggagagcgaggccgagccccagcaggagaacagagcccactgcagacaggaggacgtgggcttcagaggcaacagccccgagatgagagtggagccccagcccagaatgtgggtgcccgagagccccgtgtgcagaagcggcagaggcgagagcaagagcgagagctggagcgaggagctgcagcccggccaccccagagcctggccccccagccccggcagattcagagtggaggagggcggcggcgcccccttctgcagcgccgacggcagcaccagcgccgagaagagacacctggaggtgagcaacggcatggacgagctggccggcagccccttccccgtgaccagaatgagcagcagaagcagcgacgccaagcccctgcccgccagctaccccgccgagcccagagagccccaggagagccccaagatcaccagcgccttcagcagcgtgaagcccagcgaggccgtgcccagaaagttcgacagcggcggcgagagaggcgccggcctgcccctgagcctgagcaacaagaacagaggcctgagcgcccccgacctgagaagcgtgggcctgacccccggccaggagcagggcgccagcgagctggagggcagcctgggcgaggccagcaccatcgagatcccccccggcgagagcctgcaggccagagccgccagaatcctgggcatcgaggtggccgtggagagcctgctgcccggcatcagaagagccggccagaaccagcccgccgagcccgacgccagcgcctgcacccccgagagcccccaggaggagctgctgagcagacccgcccccgccgacgtgcccagagtgagcaccgacgccttctacggcagaagaaagtgcggctggaccaagagccccctgttcgtgggcgacagagacagcgccagaagagccccccaggccttcgagcacagcgacgtggacggcgtggtgaccagcaccgaccccgtgcccgagcccgagcccagccccctggagagcaagttcttcgagcagaaggacgtggagaccaagccccccttcagaagcaccctgttccacttcgtggagagaacccccagcgtggccggcagcgagaagagactgagaagccccagcaaggtgatcgagagcctgcaggagaagctggccagcccccccagaagagccgaccccgacagactgatgagaatgaaggaggtgagcagcgtgagcagaatgagagtgctgagcttcagaaacgccgacagccaggaggacgccgaggagctgaaggccaccaccagaggccaggccggcctgcccggcggcctggtgagccccggcagcggcgacagagcccagagactgggccacagcctgagcgtgagcaaggacagcatcagcagagaggagaaggagcaccccgccgcccagaaggagaagagcatggaccaggacttctggtgccccgacagctacgaccccagcagagtggagagagtgtag

SEQ ID NO: 95043 - DNA, 3219 bp, Artificial Sequence
  Description of Artificial Sequence: Synthetic coding sequence
atggccccccccaccggcgtgctgagcagcctgctgctgctggtgaccatcgccggctgcgccagaaagcagtgcagcgagggcagaacctacagcaacgccgtgatcagccccaacctggagaccaccagaatcatgagagtgagccacaccttccccgtggtggactgcaccgccgcctgctgcgacctgagcagctgcgacctggcctggtggttcgagggcagatgctacctggtgagctgcccccacaaggagaactgcgagcccaagaagatgggccccatcagaagctacctgaccttcgtgctgagacccgtgcagagacccgcccagctgctggactacggcgacatgatgctgaacagaggcagccccagcggcatctggggcgacagccccgaggacatcagaaaggacctgaccttcctgggcaaggactggggcctggaggagatgagcgagtacagcgacgactacagagagctggagaaggacctgctgcagcccagcggcaagcaggagcccagaggcagcgccgagtacaccgactggggcctgctgcccggcagcgagggcgccttcaacagcagcgtgggcgacagccccgccgtgcccgccgagacccagcaggaccccgagctgcactacctgaacgagagcgccagcacccccgcccccaagctgcccgagagaagcgtgctgctgcccctgcccaccacccccagcagcggcgaggtgctggagaaggagaaggccagccagctgcaggagcagagcagcaacagcagcggcaaggaggtgctgatgcccagccacagcctgccccccgccagcctggagctgagcagcgtgaccgtggagaagagccccgtgctgaccgtgacccccggcagcaccgagcacagcatccccaccccccccaccagcgccgcccccagcgagagcacccccagcgagctgcccatcagccccaccaccgcccccagaaccgtgaaggagctgaccgtgagcgccggcgacaacctgatcatcaccctgcccgacaacgaggtggagctgaaggccttcgtggcccccgccccccccgtggagaccacctacaactacgagtggaacctgatcagccaccccaccgactaccagggcgagatcaagcagggccacaagcagaccctgaacctgagccagctgagcgtgggcctgtacgtgttcaaggtgaccgtgagcagcgagaacgccttcggcgagggcttcgtgaacgtgaccgtgaagcccgccagaagagtgaacctgccccccgtggccgtggtgagcccccagctgcaggagctgaccctgcccctgaccagcgccctgatcgacggcagccagagcaccgacgacaccgagatcgtgagctaccactgggaggagatcaacggccccttcatcgaggagaagaccagcgtggacagccccgtgctgagactgagcaacctggaccccggcaactacagcttcagactgaccgtgaccgacagcgacggcgccaccaacagcaccaccgccgccctgatcgtgaacaacgccgtggactacccccccgtggccaacgccggccccaaccacaccatcaccctgccccagaacagcatcaccctgaacggcaaccagagcagcgacgaccaccagatcgtgctgtacgagtggagcctgggccccggcagcgagggcaagcacgtggtgatgcagggcgtgcagaccccctacctgcacctgagcgccatgcaggagggcgactacaccttccagctgaaggtgaccgacagcagcagacagcagagcaccgccgtggtgaccgtgatcgtgcagcccgagaacaacagaccccccgtggccgtggccggccccgacaaggagctgatcttccccgtggagagcgccaccctggacggcagcagcagcagcgacgaccacggcatcgtgttctaccactgggagcacgtgagaggccccagcgccgtggagatggagaacatcgacaaggccatcgccaccgtgaccggcctgcaggtgggcacctaccacttcagactgaccgtgaaggaccagcagggcctgagcagcaccagcaccctgaccgtggccgtgaagaaggagaacaacagcccccccagagccagagccggcggcagacacgtgctggtgctgcccaacaacagcatcaccctggacggcagcagaagcaccgacgaccagagaatcgtgagctacctgtggatcagagacggccagagccccgccgccggcgacgtgatcgacggcagcgaccacagcgtggccctgcagctgaccaacctggtggagggcgtgtacaccttccacctgagagtgaccgacagccagggcgccagcgacaccgacaccgccaccgtggaggtgcagcccgaccccagaaagagcggcctggtggagctgaccctgcaggtgggcgtgggccagctgaccgagcagagaaaggacaccctggtgagacagctggccgtgctgctgaacgtgctggacagcgacatcaaggtgcagaagatcagagcccacagcgacctgagcaccgtgatcgtgttctacgtgcagagcagaccccccttcaaggtgctgaaggccgccgaggtggccagaaacctgcacatgagactgagcaaggagaaggccgacttcctgctgttcaaggtgctgagagtggacaccgccggctgcctgctgaagtgcagcggccacggccactgcgaccccctgaccaagagatgcatctgcagccacctgtggatggagaacctgatccagagatacatctgggacggcgagagcaactgcgagtggagcatcttctacgtgaccgtgctggccttcaccctgatcgtgctgaccggcggcttcacctggctgtgcatctgctgctgcaagagacagaagagaaccaagatcagaaagaagaccaagtacaccatcctggacaacatggacgagcaggagagaatggagctgagacccaagtacggcatcaagcacagaagcaccgagcacaacagcagcctgatggtgagcgagagcgagttcgacagcgaccaggacaccatcttcagcagagagaagatggagagaggcaaccccaaggtgagcatgaacggcagcatcagaaacggcgccagcttcagctactgcagcaaggacagatag

SEQ ID NO: 95044 - DNA, 918 bp, Artificial Sequence
  Description of Artificial Sequence: Synthetic coding sequence
agccagctgcccgtgagagccgaggagagaaccgagagctgcctgtggggctgctgggccagcagcagagtgagaagaaccagcgacgcctgcagcagccccctggccaccagcagaagcgccagaagctgcggcgtgctgaccgcccccgtgaagggcgccagcagcagcctggtggtgaagctggccgacaccgacagagagagagccctgagaagaatgcagcagatggccggccacctgggcgccttccaccccgcccccctgcccctgggcgcctgcggcgcctacaccaccgccatcctgcagcaccaggccgccctgctggccgccgcccagggccccggcctgggccccgtggccgccgtggccgcccagatgcagcacgtggccgccttcagcctggtggccgcccccctgctgcccgccgccgccgccaacagcccccccggcagcggccccggcaccctgcccggcctgcccgcccccatcggcgtgaacggcttcggccccctgaccccccagaccaacggccagcccggcagcgacaccctgtacaacaacggcctgagcccctaccccgcccagagccccggcgtggccgaccccctgcagcaggcctacgccggcatgcaccactacgccggccccgagggctgcaacctgttcatctaccacctgccccaggagttcggcgacgccgagctgatccagaccttcctgcccttcggcgccgtggtgagcgccaaggtgttcgtggacagagccaccaaccagagcaagtgcttcggcttcgtgagcttcgacaaccccaccagcgcccagaccgccatccaggccatgaacggcttccagatcggcatgaagagactgaaggtgcagctgaagagacccaaggacgccaacagaccctactag

SEQ ID NO: 95045 - DNA, 198 bp, Artificial Sequence
  Description of Artificial Sequence: Synthetic coding sequence
atggtgagaaccaaggccgacagcgtgcccggcacctacagaaaggtggtggccgccagagcccccagaaaggtgctgggcagcagcaccagcgccaccaacagcaccagcgtgagcagcagaaaggagcacgtgctgtgcaacctgatcacccagatgatgaagaagaacagaaccttcagcttcatcttcgagtag

SEQ ID NO: 95046 - DNA, 15018 bp, Artificial Sequence; identical to SEQ ID NO: 95031
  Description of Artificial Sequence: Synthetic coding sequence

SEQ ID NO: 95047 - DNA, 2772 bp, Artificial Sequence; identical to SEQ ID NO: 95036
  Description of Artificial Sequence: Synthetic coding sequence

SEQ ID NO: 95048 - DNA, 2982 bp, Artificial Sequence
  Description of Artificial Sequence: Synthetic coding sequence
atgggcgccgccggcagacaggacttcctgttcaaggccatgctgaccatcagctggctgaccctgacctgcttccccggcgccaccagcaccgtggccgccggctgccccgaccagagccccgagctgcagccctggaaccccggccacgaccaggaccaccacgtgcacatcggccagggcaagaccctgctgctgaccagcagcgccaccgtgtacagcatccacatcagcgagggcggcaagctggtgatcaaggaccacgacgagcccatcgtgctgagaaccagacacatcctgatcgacaacggcggcgagctgcacgccggcagcgccctgtgccccttccagggcaacttcaccatcatcctgtacggcagagccgacgagggcatccagcccgacccctactacggcctgaagtacatcggcgtgggcaagggcggcgccctggagctgcacggccagaagaagctgagctggaccttcctgaacaagaccctgcaccccggcggcatggccgagggcggctacttcttcgagagaagctggggccacagaggcgtgatcgtgcacgtgatcgaccccaagagcggcaccgtgatccacagcgacagattcgacacctacagaagcaagaaggagagcgagagactggtgcagtacctgaacgccgtgcccgacggcagaatcctgagcgtggccgtgaacgacgagggcagcagaaacctggacgacatggccagaaaggccatgaccaagctgggcagcaagcacttcctgcacctgggcttcagacacccctggagcttcctgaccgtgaagggcaaccccagcagcagcgtggaggaccacatcgagtaccacggccacagaggcagcgccgccgccagagtgttcaagctgttccagaccgagcacggcgagtacttcaacgtgagcctgagcagcgagtgggtgcaggacgtggagtggaccgagtggttcgaccacgacaaggtgagccagaccaagggcggcgagaagatcagcgacctgtggaaggcccaccccggcaagatctgcaacagacccatcgacatccaggccaccaccatggacggcgtgaacctgagcaccgaggtggtgtacaagaagggccaggactacagattcgcctgctacgacagaggcagagcctgcagaagctacagagtgagattcctgtgcggcaagcccgtgagacccaagctgaccgtgaccatcgacaccaacgtgaacagcaccatcctgaacctggaggacaacgtgcagagctggaagcccggcgacaccctggtgatcgccagcaccgactacagcatgtaccaggccgaggagttccaggtgctgccctgcagaagctgcgcccccaaccaggtgaaggtggccggcaagcccatgtacctgcacatcggcgaggagatcgacggcgtggacatgagagccgaggtgggcctgctgagcagaaacatcatcgtgatgggcgagatggaggacaagtgctacccctacagaaaccacatctgcaacttcttcgacttcgacaccttcggcggccacatcaagttcgccctgggcttcaaggccgcccacctggagggcaccgagctgaagcacatgggccagcagctggtgggccagtaccccatccacttccacctggccggcgacgtggacgagagaggcggctacgacccccccacctacatcagagacctgagcatccaccacaccttcagcagatgcgtgaccgtgcacggcagcaacggcctgctgatcaaggacgtggtgggctacaacagcctgggccactgcttcttcaccgaggacggccccgaggagagaaacaccttcgaccactgcctgggcctgctggtgaagagcggcaccctgctgcccagcgacagagacagcaagatgtgcaagatgatcaccgaggacagctaccccggctacatccccaagcccagacaggactgcaacgccgtgagcaccttctggatggccaaccccaacaacaacctgatcaactgcgccgccgccggcagcgaggagaccggcttctggttcatcttccaccacgtgcccaccggccccagcgtgggcatgtacagccccggctacagcgagcacatccccctgggcaagttctacaacaacagagcccacagcaactacagagccggcatgatcatcgacaacggcgtgaagaccaccgaggccagcgccaaggacaagagacccttcctgagcatcatcagcgccagatacagcccccaccaggacgccgaccccctgaagcccagagagcccgccatcatcagacacttcatcgcctacaagaaccaggaccacggcgcctggctgagaggcggcgacgtgtggctggacagctgcagattcgccgacaacggcatcggcctgaccctggccagcggcggcaccttcccctacgacgacggcagcaagcaggagatcaagaacagcctgttcgtgggcgagagcggcaacgtgggcaccgagatgatggacaacagaatctggggccccggcggcctggaccacagcggcagaaccctgcccatcggccagaacttccccatcagaggcatccagctgtacgacggccccatcaacatccagaactgcaccttcagaaagttcgtggccctggagggcagacacaccagcgccctggccttcagactgaacaacgcctggcagagctgcccccacaacaacgtgaccggcatcgccttcgaggacgtgcccatcaccagcagagtgttcttcggcgagcccggcccctggttcaaccagctggacatggacggcgacaagaccagcgtgttccacgacgtggacggcagcgtgagcgagtaccccggcagctacctgaccaagaacgacaacaagtggcacagcctggccagcaaggccgccagcggccccagcggctag

SEQ ID NO: 95049 - DNA, 4086 bp, Artificial Sequence; identical to SEQ ID NO: 80223
  Description of Artificial Sequence: Synthetic coding sequence

SEQ ID NO: 95050 - DNA, 1947 bp, Artificial Sequence
  Description of Artificial Sequence: Synthetic coding sequence
atggaggtgaagggcaagaagcagttcaccggcaagagcaccaagaccgcccaggagaagaacagattccacaagaacagcgacagcggcagcagcaagaccttccccaccagaaaggtggccaaggagggcggccccaaggtgaccagcagaaacttcgagaagagcatcaccaagctgggcaagaagggcgtgaagcagttcaagaacaagcagcagggcgacaagagccccaagaacaagttccagcccgccaacaagttcaacaagaagagaaagttccagcccgacggcagaagcgacgagagcgccgccaagaagcccaagtgggacgacttcaagaagaagaagaaggagctgaagcagagcagacagctgagcgacaagaccaactacgacatcgtggtgagagccaagcagatgtgggagatcctgagaagaaaggactgcgacaaggagaagagagtgaagctgatgagcgacctgcagaagctgatccagggcaagatcaagaccatcgccttcgcccacgacagcaccagagtgatccagtgctacatccagtacggcaacgaggagcagagaaagcaggccttcgaggagctgagagacgacctggtggagctgagcaaggccaagtacagcagaaacatcgtgaagaagttcctgatgtacggcagcaagccccagatcgccgagatcatcagaagcttcaagggccacgtgagaaagatgctgagacacgccgaggccagcgccatcgtggagtacgcctacaacgacaaggccatcctggagcagagaaacatgctgaccgaggagctgtacggcaacaccttccagctgtacaagagcgccgaccacagaaccctggacaaggtgctggaggtgcagcccgagaagctggagctgatcatggacgagatgaagcagatcctgacccccatggcccagaaggaggccgtgatcaagcacagcctggtgcacaaggtgttcctggacttcttcacctacgccccccccaagctgagaagcgagatgatcgaggccatcagagaggccgtggtgtacctggcccacacccacgacggcgccagagtggccatgcactgcctgtggcacggcacccccaaggacagaaaggtgatcgtgaagaccatgaagacctacgtggagaaggtggccaacggccagtacagccacctggtgctgctggccgccttcgactgcatcgacgacaccaagctggtgaagcagatcatcatcagcgagatcatcagcagcctgcccagcatcgtgaacgacaagtacggcagaaaggtgctgctgtacctgctgagccccagagaccccgcccacaccgtgagagagatcatcgaggtgctgcagaagggcgacggcaacgcccacagcaagaaggacaccgaggtgagaagaagagagctgctggagagcatcagccccgccctgctgagctacctgcaggagcacgcccaggaggtggtgctggacaagagcgcctgcgtgctggtgagcgacatcctgggcagcgccaccggcgacgtgcagcccaccatgaacgccatcgccagcctggccgccaccggcctgcaccccggcggcaaggacggcgagctgcacatcgccgagcaccccgccggccacctggtgctgaagtggctgatcgagcaggacaagaagatgaaggagaacggcagagagggctgcttcgccaagaccctggtggagcacgtgggcatgaagaacctgaagagctgggccagcgtgaacagaggcgccatcatcctgagcagcctgctgcagagctgcgacctggaggtggccaacaaggtgaaggccgccctgaagagcctgatccccaccctggagaagaccaagagcaccagcaagggcatcgagatcctgctggagaagctgagcacctag

SEQ ID NO: 95051 - DNA, 339 bp, Artificial Sequence
  Description of Artificial Sequence: Synthetic coding sequence
atgaagaaccaggtgtgcagcaagtgcggcgagggcacctacagcctgggcagcggcatcaagttcgacgagtgggacgagctgcccgccggcttcagcaacatcgccaccttcatggacaccgtggtgggccccagcgacagcagacccgacggctgcaacaacagcagctggatccccagaggcaactacatcgagagcaacagagacgactgcaccgtgagcctgatctacgccgtgcacctgaagaagagcggctacgtgttcttcgagtaccagtacgtggacaacaacatcttcttcgagttcttcatccagaacgaccagtgccaggagtag

SEQ ID NO: 95052 - DNA, 1842 bp, Artificial Sequence
  Description of Artificial Sequence: Synthetic coding sequence
atgttcagcgccggcgccgagagcctgctgcaccaggccagagagatccaggacgaggagctgaagaagttctgcagcagaatctgcaagctgctgcaggccgaggacctgggccccgacaccctggacagcctgcagagactgttcctgatcatcagcgccaccaagtacagcagaagactggagaagacctgcgtggacctgctgcaggccaccctgggcctgcccgcctgccccgagcagctgcaggtgctgtgcgccgccatcctgagagagatgagccccagcgacagcctgagcctggcctgggaccacacccagaacagcagacagctgagcctggtggccagcgtgctgctggcccagggcgacagaaacgaggaggtgagagccgtgggccagggcgtgctgagagccctggagagcagacagcccgagggccccagcctgagacacctgctgcccgtgatggccaaggtggtggtgctgagccccggcaccctgcaggaggaccaggccaccctgctgagcaagagactggtggactggctgagatacgccagcctgcagcagggcctgccccacagcggcggcttcttcagcacccccagagccagacagcccggccccgtgaccgaggtggacggcgccgtggccaccgacttcttcaccgtgctgagcagcggccacagattcaccgacgaccagtggctgaacgtgcaggccttcagcatgctgagagcctggctgctgcacagcggccccgagggccccggcaccctggacaccgacgacagaagcgagcaggagggcagcaccctgagcgtgatcagcgccaccagcagcgccggcagactgctgccccccagagagagactgagagaggtggccttcgagtactgccagagactgatcgagcagagcaacagaagagccctgagaaagggcgacagcgacctgcagaaggcctgcctggtggaggccgtgctggtgctggacgtgctgtgcagacaggaccccagcttcctgtacagaagcctgagctgcctgaaggccctgcacggcagagtgagaggcgaccccgccagcgtgagagtgctgctgcccctggcccacttcttcctgagccacggcgaggccgccgccgtggacagcgaggccgtgtaccagcacctgttcaccagaatccccgtggagcagttccacagccccatgctggccttcgagttcatccagttctgcagagacaacctgcacctgttcagcggccacctgagcaccctgagactgagcttccccaacctgttcaagttcctggcctggaacagcccccccctgaccagcgagttcgtggccctgctgcccgccctggtggacgccggcaccgccctggagatgctgcacgccctgctggacctgccctgcctgaccgccgtgctggacctgcagctgagaagcgcccccgccgccagcgagagacccctgtgggacaccagcctgagagcccccagctgcctggaggccttcagagacccccagttccagggcctgttccagtacctgctgagacccaaggccagcggcgccaccgagagactggcccccctgcaccagctgctgcagcccatggccggctgcgccagagtggcccagtgcgcccaggccgtgcccaccctgctgcaggccttcttcagcgccgtgacccaggtggccgacggcagcctgatcaaccagctggccctgctgctgctgggcagaagcgacagcctgtaccccgcccccggctacgccgccggcgtgcacagacccgacgcctgcagacccatcctggtgcccctgtag

SEQ ID NO: 95053 - DNA, 918 bp, Artificial Sequence
  Description of Artificial Sequence: Synthetic coding sequence
atggagaaggagacctacaagaccgccaagctgatcctggagagattcgaccccgacagcaagaaggccaaggagtgcgagccccccagcgccggcgccgccgtgaccgccagacccggccaggagatcagacagagaaccgccgcccagagaaacctgagccccacccccgccagccccaaccagggcccccccccccaggtgcccgtgagccccggcccccccaaggacagcagcgcccccggcggcccccccgagagaaccgtgacccccgccctgagcagcaacgtgctgcccagacacctgggcagccccgccaccagcgtgcccggcatgggcctgcacccccccggcccccccctggccagacccatcctgcccagagagagaggcgccctggacagaatcgtggagtacctggtgggcgacggcccccagaacagatacgccctgatctgccagcagtgcttcagccacaacggcatggccctgaaggaggagttcgagtacatcgccttcagatgcgcctactgcttcttcctgaaccccgccagaaagaccagaccccaggcccccagactgcccgagttcagcttcgagaagagacaggtggtggagggcagcagcagcgtgggccccctgcccagcggcagcgtgctgagcagcgacaaccagttcaacgaggagagcctggagcacgacgtgctggacgacaacaccgagcagaccgacgacaagatccccgccaccgagcagaccaaccaggtgatcgagaaggccagcgacagcgaggagcccgaggagaagcaggagaccgagaacgaggaggccagcgtgatcgagaccaacagcaccgtgcccggcgccgacagcatccccgaccccgagctgagcggcgagagcctgaccgccgagtag

SEQ ID NO: 95054 - DNA, 2589 bp, Artificial Sequence
  Description of Artificial Sequence: Synthetic coding sequence
atgcacagcagctggatccccagaggcaactacatcgagagcaacagagacgactgcaccgtgagcctgatctacgccgtgcacctgaagaagagcggctacgtgttcttcgagtaccagtacgtggacaacaacatcttcttcgagttcttcatccagaacgaccagtgccaggagatggacaccaccaccgacaagtgggtgaagctgaccgacaacggcgagtggggcagccacagcgtgatgctgaagagcggcaccaacatcctgtactggagaaccaccggcatcctgatgggcagcaaggccgtgaagcccgtgctggtgaagaacatcaccatcgagggcgtggcctacaccagcgagtgcttcccctgcaagcccggcaccttcagcaacaagcccggcagcttcaactgccaggtgtgccccagaaacacctacagcgagaagggcgccaaggagtgcatcagatgcaaggacgacagccagttcagcgaggagggcagcagcgagtgcaccgagagacccccctgcaccaccaaggactacttccagatccacaccccctgcgacgaggagggcaagacccagatcatgtacaagtggatcgagcccaagatctgcagagaggacctgaccgacgccatcagactgccccccagcggcgagaagaaggactgccccccctgcaaccccggcttctacaacaacggcagcagcagctgccacccctgcccccccggcaccttcagcgacggcaccaaggagtgcagaccctgccccgccggcaccgagcccgccctgggcttcgagtacaagtggtggaacgtgctgcccggcaacatgaagaccagctgcttcaacgtgggcaacagcaagtgcgacggcatgaacggctgggaggtggccggcgaccacatccagagcggcgccggcggcagcgacaacgactacctgatcctgaacctgcacatccccggcttcaagccccccaccagcatgaccggcgccaccggcagcgagctgggcagaatcaccttcgtgttcgagaccctgtgcagcgccgactgcgtgctgtacttcatggtggacatcaacagaaagagcaccaacgtggtggagagctggggcggcaccaaggagaagcaggcctacacccacatcatcttcaagaacgccaccttcaccttcacctgggccttccagagaaccaaccagggccaggacaacagaagattcatcaacgacatggtgaagatctacagcatcaccgccaccaacgccgtggacggcgtggccagcagctgcagagcctgcgccctgggcagcgagcagagcggcagcagctgcgtgccctgcccccccggccactacatcgagaaggagaccaaccagtgcaaggagtgcccccccgacacctacctgagcatccaccaggtgtacggcaaggaggcctgcatcccctgcggccccggcagcaagaacaaccaggaccacagcgtgtgctacagcgactgcttcttctaccacgagaaggagaaccagagcctgcactacgacttcagcaacctgagcagcgtgggcagcctgatgaacggccccagcttcaccagcaagggcaccaagtacttccacttcttcaacatcagcctgtgcggccacgagggcaagaagatggccctgtgcaccaacaacatcaccgacttcaccgtgaaggagatcgtggccggcagcgacgactacaccaacctggtgggcgccttcgtgtgccagagcaccatcatccccagcgagagcaagggcttcagagccgccctgagcagccagagcatcatcctggccgacaccttcatcggcgtgaccgtggagaccaccctgaagaacatcaacatcaaggaggacatgttccccgtgcccaccagccagatccccgacgtgcacttcttctacaagagcagcaccgccaccaccagctgcatcaacggcagaagcaccgccgtgaagatgagatgcaaccccaccaagagcggcgccggcgtgatcagcgtgcccagcaagtgccccgccggcacctgcgacggctgcaccttctacttcctgtgggagagcgccgaggcctgccccctgtgcaccgagcacgacttccacgagatcgagggcgcctgcaagagaggcttccaggagaccctgtacgtgtggaacgagcccaagtggtgcatcaagggcatcagcctgcccgagaagaagctggccacctgcgagaccgtggacttctggctgaaggtgggcgccggcgtgggcgccttcaccgccgtgctgctggtggccctgacctgctacttctggaagaagaaccagaagctggagtacaagtacagcaagctggtgatgaccaccaacagcaaggagtgcgagctgcccgccgccgacagctgcgccatcatggagggcgaggacaacgaggaggaggtggtgtacagcaacaagcagagcctgctgggcaagctgaagagcctggccaccaaggagaaggaggaccacttcgagagcgtgcagctgaagaccagcagaagccccaacatctag

SEQ ID NO: 95055 - DNA, 5853 bp, Artificial Sequence
  Description of Artificial Sequence: Synthetic coding sequence
atgcccggcgccagaagaagaagaagaggcgccgccatggagggcaagcccagagccggcgtggccctggcccccggccccagcggcagaagacccagcgccagatgcgccagaagaagaagacccggcctgctgctgcccggcctgtggctgctgctgctggccagacccgccagctgcgcccccgacgagctgagccccgagcagcacaacctgagcctgtacagcatggagctggtgctgaagaagagcaccggccacagcgccgcccaggtggccctgaccgagaccgcccccggcagccagcacagcagccccctgcacgtgaccgccccccccagcgccaccaccttcgacaccgccttcttcaaccagggcaagcagaccaagagcaccgccgaccccagcatcttcgtggccacctacgtgagcgtgaccagcaaggaggtggccgtgaacgacgacgagatggacaacttcctgcccgacacccactggaccacccccagaatggtgagccccatccagtacatcaccgtgagcccccccggcctgcccagagaggccctggagcccatgctgacccccagcctgcccatggtgagcctgcaggacgaggaggtgaccagcggctggcagaacaccaccagacagcccgccgcctacgccgagagcgccagccacttccacaccttcagaagcgccttcagaaccagcgagggcatcgtgcccacccccggcagaaacctggtgctgtaccccaccgacgcctacagccacctgagcagcagaaccctgcccgagatcgtggccagcctgaccgagggcgtggagaccaccctgttcctgagcagcagaagcctgatgccccagcccctgggcgacggcatcaccatccccctgcccagcctgggcgaggtgagccagccccccgaggaggtgtgggccaccagcgccgacagatacaccgacgtgaccaccgtgctgagccagagcctggaggagaccatcagccccagaacctaccccaccgtgaccgccagccacgccgccctggccttcagcagaacccacagccccctgctgagcacccccctggccttcgccagcagcgccagccccaccgacgtgagcagcaaccccttcctgcccagcgacagcagcaagaccagcgagctgcacagcaacagcgccctgcccggccccgtggacaacacccacatcctgagccccgtgagcagcttcagaccctacacctggtgcgccgcctgcaccgtgcccagcccccagcaggtgctggccaccagcctgatggagaaggacgtgggcagcggcgacggcgccgagaccctgtgcatgaccgtgctggaggagagcagcatcagcctgatgagcagcgtggtggccgacttcagcgagttcgaggaggacccccaggtgttcaacaccctgttccccagcagacccatcgtgcccctgagcagcagaagcatggagatcagcgagaccagcgtgggcatcagcgccgaggtggacatgagcagcgtgaccaccacccaggtgccccccgcccacggcagactgagcgtgcccgccagcctggaccccaccgccggcagcctgagcgtggccgagacccaggtgacccccagcagcgtgaccaccgccttcttcagcgtgatcaccagcatcctgctggacagcagcttcagcgtgatcgccaacaagaacacccccagcctggccgtgagagaccccagcgtgttcaccccctacagcctggtgcccagcgtggagagcagcctgttcagcgaccaggagagaagcagcttcagcgagcacaagcccagaggcgccctggacttcgccagcagcttcttcagcaccccccccctggagctgagcggcagcatcagcagccccagcgaggcccccgccagcctgagcctgatgcccagcgacctgagccccttcaccagccagagcttcagccccctggtggagaccttcaccctgttcgacagcagcgacctgcagagcagccagctgagcctgcccagcagcaccaacctggagttcagccagctgcagcccagcagcgagctgcccctgaacaccatcatgctgctgcccagcagaagcgaggtgagcccctggagcagcttccccagcgacagcctggagttcgtggaggccagcaccgtgagcctgaccgacagcgaggcccacttcaccagcgccttcatcgagaccaccagctacctggagagcagcctgatcagccacgagagcgccgtgaccgccctggtgccccccggcagcgagagcttcgacatcctgaccgccggcatccaggccaccagccccctgaccaccgtgcacaccacccccatcctgaccgagagcagcctgttcagcaccctgaccccccccgacgaccagatcagcgccctggacggccacgtgagcgtgctggccagcttcagcaaggccatccccaccggcaccgtgctgatcaccgacgcctacctgcccagcggcagcagcttcgtgagcgaggccacccccttccccctgcccaccgagctgaccgtggtgggccccagcctgacccccaccgaggtgcccctgaacaccagcaccgaggtgagcaccaccagcaccggcgccgccaccggcggccccctggacagcaccctgatgggcgacgccgccagccagagcccccccgagagcagcgccgccccccccctgcccagcctgagacccgtgaccgccttcaccctggaggccaccgtggacacccccaccctggccaccgccaagcccccctacgtgtgcgacatcaccgtgcccgacgcctacctgatcaccaccgtgctggccagaagagccgtgcaggagtacatcatcaccgccatcaaggaggtgctgagaatccacttcaacagagccgtggagctgaaggtgtacgagctgttcaccgacttcaccttcctggtgaccagcggccccttcgtgtacaccgccatcagcgtgatcaacgtgctgatcaacagcaagctggtgagagaccagacccccctgatcctgagcgtgaagcccagcttcctggtgcccgagagcagattccaggtgcagaccgtgctgcagttcgtgccccccagcgtggacaccggcttctgcaacttcacccagagaatcgagaagggcctgatgaccgccctgttcgaggtgagaaagcaccaccagggcacctacaacctgaccgtgcagatcctgaacatcaccatcagcagcagcagagtgacccccagaagaggccccgtgaacatcatcttcgccgtgaagagcacccagggcttcctgaacggcagcgaggtgagcgagctgctgagaaacctgagcgtggtggagttcagcttctacctgggctaccccgtgctgcagatcgccgagcccttccagtacccccagctgaacctgagccagctgctgaagagcagctgggtgagaaccgtgctgctgggcgtgatggagaagcagctgcagaacgaggtgttccaggccgagatggagagaaagctggcccagctgctgagcgaggtgagcaccagaagaagaatgtggagaagagccaccgtggccgccggcaacagcgtggtgcaggtggtgaacgtgagcagactggagggcgacgacaaccccgtgcagctgatctacttcgtggaggaccaggacggcgagagactgagcgccgtgaagagcagcgacctgatcaacaagatggacctgcagagagccgccatcatcctgggctacagaatccagggcgtgatcgcccagcccgtggacagagtgaagagacccagccccgagagccagagcaacaacctgtgggtgatcgtgggcgtggtgatccccgtgctggtggtgatggtgatcgtggtgatcctgtactggaagctgtgcagaaccgacaagctggacttccagcccgacaccgtggccaacatccagcagagacagaagctgcagatccccagcgtgaagggcttcgacttcgccaagcagcacctgggccagcacaacaaggacgacatcctgatcatccacgagcccgcccccctgcccggccccctgaaggaccacaccacccccagcgagaacggcgacgtgcccagccccaagagcaagatccccagcaagaacgtgagacacagaggcagagtgagccccagcgacgccgacagcaccgtgagcgaggagagcagcgagagagacgccggcgacaagacccccggcgccgtgaacgacggcagaagccacagagccccccagagcggcccccccctgcccagcagcggcaacgagcagcacagcagcgccagcatcttcgagcacgtggacagaatcagcagaccccccgaggccagcagaagagtgcccagcaagatccagctgatcgccatgcagcccatccccgccccccccgtgcagagacccagccccgccgacagagtggccgagagcaacaagatcaacaaggagatccagaccgccctgagacacaagagcgagatcgagcaccacagaaacaagatcagactgagagccaagagaagaggccactacgagttccccgtggtggacgacctgagcagcggcgacaccaaggagagacacagagtgtacagaagagcccagatgcagatcgacaagatcctggaccccaccgccagcgtgcccagcgtgttcatcgagcccagaaagagcagcagaatcaagagaagccccaagcccagaagaaagcaccaggtgaacggctgccccgccgacgccgagaaggacagactgatcaccaccgacagcgacggcacctacagaagaccccccggcgtgcacaacagcgcctacatcggctgccccagcgaccccgacctgcccgccgacgtgcagacccccagcagcgtggagctgggcagataccccgccctgcccttccccgccagccagtacatccccccccagcccagcatcgaggaggccagacagaccatgcacagcctgctggacgacgccttcgccctggtggcccccagcagccagcccgccagcaccgccggcgtgggccccggcgtgccccccggcctgcccgccaacagcacccccagccaggaggagagaagagccacccagtggggcagcttctacagccccgcccagaccgccaacaacccctgcagcagatacgaggactacggcatgaccccccccaccggccccctgcccagacccggcttcggccccggcctgctgcagagcaccgagctggtgccccccgacccccagcagccccaggccagcgccgaggcccccttcgccgccagaggcatctacagcgaggagatgcccagcgtggccagacccagacccgtgggcggcaccaccggcagccagatccagcacctgacccaggtgggcatcgccagcagaatcggcgcccagcccgtggagatcccccccagcagaggcagccagtacggcggccccggctggcccagctacggcgaggacgaggccggcagaagagaggccacccacatgctgggccaccaggagtacagcagcagccccctgttccaggtgcccagaaccagcggcagagagcccagcgcccccagcggcaacctgccccacagaggcctgcagggccccggcctgggctaccccaccagcagcaccgaggacctgcagcccggccacagcagcgccagcctgatcaaggccatcagagaggagctgctgagactgagccagaagcagagcaccgtgcagaacttccacagctag

SEQ ID NO: 95056 - DNA, 357 bp, Artificial Sequence
  Description of Artificial Sequence: Synthetic coding sequence
tgaaagagcaacggcaagaccgccatcggcgaccccggcagagccaacatgcccggctacaacgaggacagcagaagcaccttcttcgacaagaagtacagcaacatgagcaccctgggcaacaacggccccacccacaagaagctgtacagacacaagagcagcagcaaggccctgagagacgagaagtgcaagggcaagcacatggagagagagcaggtgcacaaggacgagagcggcaccgccagcttcgagaagctgagagacagcgactacaacctgctgaaggccgagaccaccttctgggtgctgcccgtgttcgaggaggagaccagaatcttccagaaggacatctag

SEQ ID NO: 95057 - DNA, 3084 bp, Artificial Sequence
  Description of Artificial Sequence: Synthetic coding sequence
atgagagtgagccacaccttccccgtggtggactgcaccgccgcctgctgcgacctgagcagctgcgacctggcctggtggttcgagggcagatgctacctggtgagctgcccccacaaggagaactgcgagcccaagaagatgggccccatcagaagctacctgaccttcgtgctgagacccgtgcagagacccgcccagctgctggactacggcgacatgatgctgaacagaggcagccccagcggcatctggggcgacagccccgaggacatcagaaaggacctgaccttcctgggcaaggactggggcctggaggagatgagcgagtacagcgacgactacagagagctggagaaggacctgctgcagcccagcggcaagcaggagcccagaggcagcgccgagtacaccgactggggcctgctgcccggcagcgagggcgccttcaacagcagcgtgggcgacagccccgccgtgcccgccgagacccagcaggaccccgagctgcactacctgaacgagagcgccagcacccccgcccccaagctgcccgagagaagcgtgctgctgcccctgcccaccacccccagcagcggcgaggtgctggagaaggagaaggccagccagctgcaggagcagagcagcaacagcagcggcaaggaggtgctgatgcccagccacagcctgccccccgccagcctggagctgagcagcgtgaccgtggagaagagccccgtgctgaccgtgacccccggcagcaccgagcacagcatccccaccccccccaccagcgccgcccccagcgagagcacccccagcgagctgcccatcagccccaccaccgcccccagaaccgtgaaggagctgaccgtgagcgccggcgacaacctgatcatcaccctgcccgacaacgaggtggagctgaaggccttcgtggcccccgccccccccgtggagaccacctacaactacgagtggaacctgatcagccaccccaccgactaccagggcgagatcaagcagggccacaagcagaccctgaacctgagccagctgagcgtgggcctgtacgtgttcaaggtgaccgtgagcagcgagaacgccttcggcgagggcttcgtgaacgtgaccgtgaagcccgccagaagagtgaacctgccccccgtggccgtggtgagcccccagctgcaggagctgaccctgcccctgaccagcgccctgatcgacggcagccagagcaccgacgacaccgagatcgtgagctaccactgggaggagatcaacggccccttcatcgaggagaagaccagcgtggacagccccgtgctgagactgagcaacctggaccccggcaactacagcttcagactgaccgtgaccgacagcgacggcgccaccaacagcaccaccgccgccctgatcgtgaacaacgccgtggactacccccccgtggccaacgccggccccaaccacaccatcaccctgccccagaacagcatcaccctgaacggcaaccagagcagcgacgaccaccagatcgtgctgtacgagtggagcctgggccccggcagcgagggcaagcacgtggtgatgcagggcgtgcagaccccctacctgcacctgagcgccatgcaggagggcgactacaccttccagctgaaggtgaccgacagcagcagacagcagagcaccgccgtggtgaccgtgatcgtgcagcccgagaacaacagaccccccgtggccgtggccggccccgacaaggagctgatcttccccgtggagagcgccaccctggacggcagcagcagcagcgacgaccacggcatcgtgttctaccactgggagcacgtgagaggccccagcgccgtggagatggagaacatcgacaaggccatcgccaccgtgaccggcctgcaggtgggcacctaccacttcagactgaccgtgaaggaccagcagggcctgagcagcaccagcaccctgaccgtggccgtgaagaaggagaacaacagcccccccagagccagagccggcggcagacacgtgctggtgctgcccaacaacagcatcaccctggacggcagcagaagcaccgacgaccagagaatcgtgagctacctgtggatcagagacggccagagccccgccgccggcgacgtgatcgacggcagcgaccacagcgtggccctgcagctgaccaacctggtggagggcgtgtacaccttccacctgagagtgaccgacagccagggcgccagcgacaccgacaccgccaccgtggaggtgcagcccgaccccagaaagagcggcctggtggagctgaccctgcaggtgggcgtgggccagctgaccgagcagagaaaggacaccctggtgagacagctggccgtgctgctgaacgtgctggacagcgacatcaaggtgcagaagatcagagcccacagcgacctgagcaccgtgatcgtgttctacgtgcagagcagaccccccttcaaggtgctgaaggccgccgaggtggccagaaacctgcacatgagactgagcaaggagaaggccgacttcctgctgttcaaggtgctgagagtggacaccgccggctgcctgctgaagtgcagcggccacggccactgcgaccccctgaccaagagatgcatctgcagccacctgtggatggagaacctgatccagagatacatctgggacggcgagagcaactgcgagtggagcatcttctacgtgaccgtgctggccttcaccctgatcgtgctgaccggcggcttcacctggctgtgcatctgctgctgcaagagacagaagagaaccaagatcagaaagaagaccaagtacaccatcctggacaacatggacgagcaggagagaatggagctgagacccaagtacggcatcaagcacagaagcaccgagcacaacagcagcctgatggtgagcgagagcgagttcgacagcgaccaggacaccatcttcagcagagagaagatggagagaggcaaccccaaggtgagcatgaacggcagcatcagaaacggcgccagcttcagctactgcagcaaggacagatag

SEQ ID NO: 95058 - DNA, 1821 bp, Artificial Sequence
  Description of Artificial Sequence: Synthetic coding sequence
atgggcaacacctgcagagtgtgctaccagctggaggccatcaagagaagcaacgagatgagcaacgtgatgggcaacaccacctggaccaccagcggcctgaagagccagggcagactgagcgtgggcagcaacagagacagagagatcagcatgagcgtgggcctgggcagaagccagctggacagcaagggcggcgtggtgggcggcaccatcgacgtgaacgccctggagatggtggcccacatcagcgagcaccccaaccagcagcccagccacaagatccagatcaccatgggcagcaccgaggccagagtggactacatgggcagcagcatcctgatgggcatcttcagcaacgccgacctgaagctgcaggacgagtggaaggtgaacctgtacaacaccctggacagcagcatcaccgacaagagcgagatcttcgtgcacggcgacctgaagtgggacatcttccaggtgatgatcagcagaagcaccacccccgacctgatcaagatcggcatgaagctgcaggagttcttcacccagcagttcgacaccagcaagagagccctgagcacctggggccccgtgccctacctgccccccaagaccatgaccagcaacctggagaagagcagccaggagcagctgctggacgccgcccaccacagacactggcccggcgtgctgaaggtggtgagcggctgccacatcagcctgttccagatccccctgcccgaggacggcatgcagttcggcggcagcatgagcctgcacggcaaccacatgaccctggcctgcttccacggccccaacttcagaagcaagagctgggccctgttccacctggaggagcccaacatcgccttctggaccgaggcccagaagatctgggaggacggcagcagcgaccacagcacctacatcgtgcagaccctggacttccacctgggccacaacaccatggtgaccaagccctgcggcgccctggagagccccatggccaccatcaccaagatcaccagaagaagacacgagaaccccccccacggcgtggccagcgtgaaggagtggttcaactacgtgaccgccaccagaaacgaggagctgaacctgctgagaaacgtggacgccaacaacaccgagaacagcaccaccgtgaagaacagcagcctgctgagcggcttcagaggcggcagcagctacaaccacgagaccgagaccatcttcgccctgcccagaatgcagctggacttcaagagcatccacgtgcaggagccccaggagcccagcctgcaggacgccagcctgaagcccaaggtggagtgcagcgtggtgaccgagttcaccgaccacatctgcgtgaccatggacgccgagctgatcatgttcctgcacgacctggtgagcgcctacctgaaggagaaggagaaggccatcttcccccccagaatcctgagcaccagacccggccagaagagccccatcatcatccacgacgacaacagcagcgacaaggacagagaggacagcatcacctacaccaccgtggactggagagacttcatgtgcaacacctggcacctggagcccaccctgagactgatcagctggaccggcagaaagatcgaccccgtgggcgtggactacatcctgcagaagctgggcttccaccacgccagaaccaccatccccaagtggctgcagagaggcgtgatggaccccctggacaaggtgctgagcgtgctgatcaagaagctgggcaccgccctgcaggacgagaaggagaagaagggcaaggacaaggaggagcactag

SEQ ID NO: 95059 - DNA, 5805 bp, Artificial Sequence
  Description of Artificial Sequence: Synthetic coding sequence
atgcccggcgccagaagaagaagaagaggcgccgccatggagggcaagcccagagccggcgtggccctggcccccggccccagcggcagaagacccagcgccagatgcgccagaagaagaagacccggcctgctgctgcccggcctgtggctgctgctgctggccagacccgccagctgcgcccccgacgagctgagccccgagcagcacaacctgagcctgtacagcatggagctggtgctgaagaagagcaccggccacagcgccgcccaggtggccctgaccgagaccgcccccggcagccagcacagcagccccctgcacgtgaccgccccccccagcgccaccaccttcgacaccgccttcttcaaccagggcaagcagaccaagagcaccgccgaccccagcatcttcgtggccacctacgtgagcgtgaccagcaaggaggtggccgtgaacgacgacgagatggacaacttcctgcccgacacccactggaccacccccagaatggtgagccccatccagtacatcaccgtgagcccccccggcctgcccagagaggccctggagcccatgctgacccccagcctgcccatggtgagcctgcaggacgaggaggtgaccagcggctggcagaacaccaccagacagcccgccgcctacgccgagagcgccagccacttccacaccttcagaagcgccttcagaaccagcgagggcatcgtgcccacccccggcagaaacctggtgctgtaccccaccgacgcctacagccacctgagcagcagaaccctgcccgagatcgtggccagcctgaccgagggcgtggagaccaccctgttcctgagcagcagaagcctgatgccccagcccctgggcgacggcatcaccatccccctgcccagcctgggcgaggtgagccagccccccgaggaggtgtgggccaccagcgccgacagatacaccgacgtgaccaccgtgctgagccagagcctggaggagaccatcagccccagaacctaccccaccgtgaccgccagccacgccgccctggccttcagcagaacccacagccccctgctgagcacccccctggccttcgccagcagcgccagccccaccgacgtgagcagcaaccccttcctgcccagcgacagcagcaagaccagcgagctgcacagcaacagcgccctgcccggccccgtggacaacacccacatcctgagccccgtgagcagcttcagaccctacacctggtgcgccgcctgcaccgtgcccagcccccagcaggtgctggccaccagcctgatggagaaggacgtgggcagcggcgacggcgccgagaccctgtgcatgaccgtgctggaggagagcagcatcagcctgatgagcagcgtggtggccgacttcagcgagttcgaggaggacccccaggtgttcaacaccctgttccccagcagacccatcgtgcccctgagcagcagaagcatggagatcagcgagaccagcgtgggcatcagcgccgaggtggacatgagcagcgtgaccaccacccaggtgccccccgcccacggcagactgagcgtgcccgccagcctggaccccaccgccggcagcctgagcgtggccgagacccaggtgacccccagcagcgtgaccaccgccttcttcagcgtgatcaccagcatcctgctggacagcagcttcagcgtgatcgccaacaagaacacccccagcctggccgtgagagaccccagcgtgttcaccccctacagcctggtgcccagcgtggagagcagcctgttcagcgaccaggagagaagcagcttcagcgagcacaagcccagaggcgccctggacttcgccagcagcttcttcagcaccccccccctggagctgagcggcagcatcagcagccccagcgaggcccccgccagcctgagcctgatgcccagcgacctgagccccttcaccagccagagcttcagccccctggtggagaccttcaccctgttcgacagcagcgacctgcagagcagccagctgagcctgcccagcagcaccaacctggagttcagccagctgcagcccagcagcgagctgcccctgaacaccatcatgctgctgcccagcagaagcgaggtgagcccctggagcagcttccccagcgacagcctggagttcgtggaggccagcaccgtgagcctgaccgacagcgaggcccacttcaccagcgccttcatcgagaccaccagctacctggagagcagcctgatcagccacgagagcgccgtgaccgccctggtgccccccggcagcgagagcttcgacatcctgaccgccggcatccaggccaccagccccctgaccaccgtgcacaccacccccatcctgaccgagagcagcctgttcagcaccctgaccccccccgacgaccagatcagcgccctggacggccacgtgagcgtgctggccagcttcagcaaggccatccccaccggcaccgtgctgatcaccgacgcctacctgcccagcggcagcagcttcgtgagcgaggccacccccttccccctgcccaccgagctgaccgtggtgggccccagcctgacccccaccgaggtgcccctgaacaccagcaccgaggtgagcaccaccagcaccggcgccgccaccggcggccccctggacagcaccctgatgggcgacgccgccagccagagcccccccgagagcagcgccgccccccccctgcccagcctgagacccgtgaccgccttcaccctggaggccaccgtggacacccccaccctggccaccgccaagcccccctacgtgtgcgacatcaccgtgcccgacgcctacctgatcaccaccgtgctggccagaagagccgtgcaggagtacatcatcaccgccatcaaggaggtgctgagaatccacttcaacagagccgtggagctgaaggtgtacgagctgttcaccgacttcaccttcctggtgaccagcggccccttcgtgtacaccgccatcagcgtgatcaacgtgctgatcaacagcaagctggtgagagaccagacccccctgatcctgagcgtgaagcccagcttcctggtgcccgagagcagattccaggtgcagaccgtgctgcagttcgtgccccccagcgtggacaccggcttctgcaacttcacccagagaatcgagaagggcctgatgaccgccctgttcgaggtgagaaagcaccaccagggcacctacaacctgaccgtgcagatcctgaacatcaccatcagcagcagcagagtgacccccagaagaggccccgtgaacatcatcttcgccgtgaagagcacccagggcttcctgaacggcagcgaggtgagcgagctgctgagaaacctgagcgtggtggagttcagcttctacctgggctaccccgtgctgcagatcgccgagcccttccagtacccccagctgaacctgagccagctgctgaagagcagctgggtgagaaccgtgctgctgggcgtgatggagaagcagctgcagaacgaggtgttccaggccgagatggagagaaagctggcccagctgctgagcgaggtgagcaccagaagaagaatgtggagaagagccaccgtggccgccggcaacagcgtggtgcaggtggtgaacgtgagcagactggagggcgacgacaaccccgtgcagctgatctacttcgtggaggaccaggacggcgagagactgagcgccgtgaagagcagcgacctgatcaacaagatggacctgcagagagccgccatcatcctgggctacagaatccagggcgtgatcgcccagcccgtggacagagtgaagagacccagccccgagagccagagcaacaacctgtgggtgatcgtgggcgtggtgatccccgtgctggtggtgatggtgatcgtggtgatcctgtactggaagctgtgcagaaccgacaagctggacttccagcccgacaccgtggccaacatccagcagagacagaagctgcagatccccagcgtgaagggcttcgacttcgccaagcagcacctgggccagcacaacaaggacgacatcctgatcatccacgagcccgcccccctgcccggccccctgaaggaccacaccacccccagcgagaacggcgacgtgcccagccccaagagcaagatccccagcaagaacgtgagacacagaggcagagtgagccccagcgacgccgacagcaccgtgagcgaggagagcagcgagagagacgccggcgacaagacccccggcgccgtgaacgacggcagaagccacagagccccccagagcggcccccccctgcccagcagcggcaacgagcagcacagcagcgccagcatcttcgagcacgtggacagaatcagcagaccccccgaggccagcagaagagtgcccagcaagatccagctgatcgccatgcagcccatccccgccccccccgtgcagagacccagccccgccgacagagtggccgagagcaacaagatcaacaaggagatccagaccgccctgagacacaagagcgagatcgagcaccacagaaacaagatcagactgagagccaagagaagaggccactacgagttccccgtggtggacgacctgagcagcggcgacaccaaggagagacacagagtgtacagaagagcccagatgcagatcgacaagatcctggaccccaccgccagcgtgcccagcgtgttcatcgagcccagaaagagcagcagaatcaagagaagccccaagcccagaagaaagcaccaggtgaacggctgccccgccgacgccgagaaggacagactgatcaccaccgacagcgacggcacctacagaagaccccccggcgtgcacaacagcgcctacatcggctgccccagcgaccccgacctgcccgccgacgtgcagacccccagcagcgtggagctgggcagataccccgccctgcccttccccgccagccagtacatccccccccagcccagcatcgaggaggccagacagaccatgcacagcctgctggacgacgccttcgccctggtggcccccagcagccagcccgccagcaccgccggcgtgggccccggcgtgccccccggcctgcccgccaacagcacccccagccaggaggagagaagagccacccagtggggcagcttctacagccccgcccagaccgccaacaacccctgcagcagatacgaggactacggcatgaccccccccaccggccccctgcccagacccggcttcggccccggcctgctgcagagcaccgagctggtgccccccgacccccagcagccccaggccagcgccgaggcccccttcgccgccagaggcatctacagcgaggagatgcccagcgtggccagacccagacccgtgggcggcaccaccggcagccagatccagcacctgacccaggtgggcatcgccagcagaatcggcgcccagcccgtggagatcccccccagcagaggcagccagtacggcggccccggctggcccagctacggcgaggacgaggccggcagaagagaggccgtgcccagaaccagcggcagagagcccagcgcccccagcggcaacctgccccacagaggcctgcagggccccggcctgggctaccccaccagcagcaccgaggacctgcagcccggccacagcagcgccagcctgatcaaggccatcagagaggagctgctgagactgagccagaagcagagcaccgtgcagaacttccacagctag

SEQ ID NO: 95060 - DNA, 252 bp, Artificial Sequence
  Description of Artificial Sequence: Synthetic coding sequence
atgggcggcctgttcagcagatggagaaccaagcccagcaccgtggaggtgctggagagcatcgacaaggagatccaggccctggaggagttcagagagaagaaccagagactgcagaagctgtgggtgggcagactgatcctgtacagcagcgtgctgtacctgttcacctgcctgatcgtgtacctgtggtacctgcccgacgagttcaccgccagactggccatgaccctgcccttcttcgccttctag

SEQ ID NO: 95061 - DNA, 3090 bp, Artificial Sequence
  Description of Artificial Sequence: Synthetic coding sequence
atgctgttcagagccagaggccccgtgagaggcagaggctggggcagacccgccgaggcccccagaagaggcagaagccccccctggagccccgcctggatctgctgctgggccctggccggctgccaggccgcctgggccggcgacctgcccagcagcagcagcagacccctgcccccctgccaggagaaggactaccacttcgagtacaccgagtgcgacagcagcggcagcagatggagagtggccatccccaacagcgccgtggactgcagcggcctgcccgaccccgtgagaggcaaggagtgcaccttcagctgcgccagcggcgagtacctggagatgaagaaccaggtgtgcagcaagtgcggcgagggcacctacagcctgggcagcggcatcaagttcgacgagtgggacgagctgcccgccggcttcagcaacatcgccaccttcatggacaccgtggtgggccccagcgacagcagacccgacggctgcaacaacagcagctggatccccagaggcaactacatcgagagcaacagagacgactgcaccgtgagcctgatctacgccgtgcacctgaagaagagcggctacgtgttcttcgagtaccagtacgtggacaacaacatcttcttcgagttcttcatccagaacgaccagtgccaggagatggacaccaccaccgacaagtgggtgaagctgaccgacaacggcgagtggggcagccacagcgtgatgctgaagagcggcaccaacatcctgtactggagaaccaccggcatcctgatgggcagcaaggccgtgaagcccgtgctggtgaagaacatcaccatcgagggcgtggcctacaccagcgagtgcttcccctgcaagcccggcaccttcagcaacaagcccggcagcttcaactgccaggtgtgccccagaaacacctacagcgagaagggcgccaaggagtgcatcagatgcaaggacgacagccagttcagcgaggagggcagcagcgagtgcaccgagagacccccctgcaccaccaaggactacttccagatccacaccccctgcgacgaggagggcaagacccagatcatgtacaagtggatcgagcccaagatctgcagagaggacctgaccgacgccatcagactgccccccagcggcgagaagaaggactgccccccctgcaaccccggcttctacaacaacggcagcagcagctgccacccctgcccccccggcaccttcagcgacggcaccaaggagtgcagaccctgccccgccggcaccgagcccgccctgggcttcgagtacaagtggtggaacgtgctgcccggcaacatgaagaccagctgcttcaacgtgggcaacagcaagtgcgacggcatgaacggctgggaggtggccggcgaccacatccagagcggcgccggcggcagcgacaacgactacctgatcctgaacctgcacatccccggcttcaagccccccaccagcatgaccggcgccaccggcagcgagctgggcagaatcaccttcgtgttcgagaccctgtgcagcgccgactgcgtgctgtacttcatggtggacatcaacagaaagagcaccaacgtggtggagagctggggcggcaccaaggagaagcaggcctacacccacatcatcttcaagaacgccaccttcaccttcacctgggccttccagagaaccaaccagggccaggacaacagaagattcatcaacgacatggtgaagatctacagcatcaccgccaccaacgccgtggacggcgtggccagcagctgcagagcctgcgccctgggcagcgagcagagcggcagcagctgcgtgccctgcccccccggccactacatcgagaaggagaccaaccagtgcaaggagtgcccccccgacacctacctgagcatccaccaggtgtacggcaaggaggcctgcatcccctgcggccccggcagcaagaacaaccaggaccacagcgtgtgctacagcgactgcttcttctaccacgagaaggagaaccagagcctgcactacgacttcagcaacctgagcagcgtgggcagcctgatgaacggccccagcttcaccagcaagggcaccaagtacttccacttcttcaacatcagcctgtgcggccacgagggcaagaagatggccctgtgcaccaacaacatcaccgacttcaccgtgaaggagatcgtggccggcagcgacgactacaccaacctggtgggcgccttcgtgtgccagagcaccatcatccccagcgagagcaagggcttcagagccgccctgagcagccagagcatcatcctggccgacaccttcatcggcgtgaccgtggagaccaccctgaagaacatcaacatcaaggaggacatgttccccgtgcccaccagccagatccccgacgtgcacttcttctacaagagcagcaccgccaccaccagctgcatcaacggcagaagcaccgccgtgaagatgagatgcaaccccaccaagagcggcgccggcgtgatcagcgtgcccagcaagtgccccgccggcacctgcgacggctgcaccttctacttcctgtgggagagcgccgaggcctgccccctgtgcaccgagcacgacttccacgagatcgagggcgcctgcaagagaggcttccaggagaccctgtacgtgtggaacgagcccaagtggtgcatcaagggcatcagcctgcccgagaagaagctggccacctgcgagaccgtggacttctggctgaaggtgggcgccggcgtgggcgccttcaccgccgtgctgctggtggccctgacctgctacttctggaagaagaaccagaagctggagtacaagtacagcaagctggtgatgaccaccaacagcaaggagtgcgagctgcccgccgccgacagctgcgccatcatggagggcgaggacaacgaggaggaggtggtgtacagcaacaagcagagcctgctgggcaagctgaagagcctggccaccaaggagaaggaggaccacttcgagagcgtgcagctgaagaccagcagaagccccaacatctag

SEQ ID NO: 95062 - DNA, 11043 bp, Artificial Sequence
  Description of Artificial Sequence: Synthetic coding sequence
atggaccagagaaagaacgagagcatcgtgcccagcatcacccagctggaggacttcctgaccgagcacaacagcaacgtggtgtggctgctggtggccaccatcctgagctgcggctggatcatctacctgacctactacaacagcagaaacgtgggcctgatcctgaccctggtgctgaacagactgtacaagcacggctacatccacatcggcagcttcagcttcagcgtgctgagcggcaaggtgatggtgagagagatctactacatcaccgaggacatgagcatcagaatccaggacggcttcatcatcttcagatggtggaagatgtacaaccccaagcagaagcagcacgaccccaaggccgagaccagactgtacatcaccgtgaacgacttcgagttccacgtgtacaacagaagcgacctgtacggcagactgcaggagctgttcggcctggagcccaccatcatcccccccaagaaggacgacgacaagaccagagagatcggcagaaccagaacccagagcaagatcgagagagtgaaggtgaagaccgagagccaggaccccaccagcagctggagaagcctgatccccgtgatcaaggtgaacgtgagcaccggcagactggccttcggcaaccactaccagccccagaccctgtgcatcaacttcgacgacgccttcctgacctacaccaccaagccccccagcagccacctggaccagttcatgcacatcgtgaagggcaagctggagaacgtgagagtgatgctggtgcccagccccagatacgtgggcctgcagaacgacgagccccccagactgatgggcgagggcttcgtggtgatgcagagcaacgacgtggacatctactactacatggacgagcccggcctggtgcccgaggagaccgaggagaacatcgagggcgagatgagcagcgaggactgcaagctgcaggacctgcccccctgctggggcctggacatcgtgtgcggcaagggcaccgacttcaactacggcccctgggccgacagacagagagactgcctgtggaagttcttcttcccccccgactaccaggtgctgaaggtgagcgagatcgcccagcccggcagacccagacagatcctggccttcgagctgagaatgaacatcatcgccgacgccaccatcgacctgctgttcaccaagaacagagagaccaacgccgtgcacgtgaacgtgggcgccggcagctacctggagatcaacatccccatgaccgtggaggagaacggctacacccccgccatcaagggccagctgctgcacgtggacgccaccaccagcatgcagtacagaaccctgctggaggccgagatgctggccttccacatcaacgccagctaccccagaatctggaacatgccccagacctggcagtgcgagctggaggtgtacaaggccacctaccacttcatcttcgcccagaagaacttcttcaccgacctgatccaggactggagcagcgacagcccccccgacatcttcagcttcgtgccctacacctggaacttcaagatcatgttccaccagttcgagatgatctgggccgccaaccagcacaactggatcgactgcagcaccaagcagcaggagaacgtgtacctggccgcctgcggcgagaccctgaacatcgacttcagcctgcccttcaccgacttcgtgcccgccacctgcaacaccaagttcagcctgagaggcgaggacgtggacctgcacctgttcctgcccgactgccaccccagcaagtacagcctgttcatgctggtgaagaactgccaccccaacaagatgatccacgacaccggcatccccgccgagtgccagagcggccagaagaccgtgaagcccaagtggagaaacgtgacccaggagaagagcggctgggtggagtgctggaccgtgcccagcgtgatgctgaccatcgactacacctggcaccccatctacccccagaaggccgacgagcagctgaagcagagcctgagcgagatggaggagaccatgctgagcgtgctgagacccagccagaagaccagcgacagagtggtgagcagccccagcaccagcagcagaccccccatcgaccccagcgagctgccccccgacaagctgcacgtggagatggagctgagccccgacagccagatcaccctgtacggccccctgctgaacgccttcctgtgcatcaaggagaactacttcggcgaggacgacatgtacatggacttcgaggaggtgatcagcagccccgtgctgagcctgagcaccagcagcagcagcggctggaccgccgtgggcatggagaacgacaagaaggagaacgagggcagcgccaagagcatccaccccctggccctgagaccctgggacatcaccgtgctggtgaacctgtacaaggtgcacggcagactgcccgtgcacggcaccaccgacggccccgagtgccccaccgccttcctggagagactgtgcttcgagatgaagaagggcttcagagagaccatgctgcagctgatcctgagccccctgaacgtgttcgtgagcgacaactaccagcagagaccccccgtggacgaggtgctgagagagggccacatcaacctgagcggcctgcagctgagagcccacgccatgttcagcgccgagggcctgcccctgggcagcgacagcctggagtacgcctggctgatcgacgtgcaggccggcagcctgaccgccaaggtgaccgccccccagctggcctgcctgctggagtggggccagaccttcgtgttccacgtggtgtgcagagagtacgagctggagagacccaagagcgtgatcatctgccagcacggcatcgacagaagattctgcgagagcaagctgagctgcatccccggcccctgccccaccagcgacgacctgaagtacaccatgatcagactggccgtggacggcgccgacatctacatcgtggagcacggctgcgccaccaacatcaagatgggcgccatcagagtggccaactgcaacctgcacaaccagagcgtgggcgagggcatcagcgccgccatccaggacttccaggtgagacagtacatcgagcagctgaacaactgcagaatcggcctgcagcccgccgtgctgagaagagcctactggctggaggccggcagcgccaacctgggcctgatcaccgtggacatcgccctggccgccgaccaccacagcaagcacgaggcccagagacacttcctggagacccacgacgccagaaccaagagactgtggttcctgtggcccgacgacatcctgaagaacaagagatgcagaaacaagtgcggctgcctgggcggctgcagattcttcggcggcaccgtgaccggcctggacttcttcaagctggaggagctgacccccagcagcagcagcgccttcagcagcaccagcgccgagagcgacatgtactacggccagagcctgctgcagcccggcgagtggatcatcaccaaggagatccccaagatcatcgacggcaacgtgaacggcatgaagagaaaggagtgggagaacaagagcgtgggcatcgaggtggagagaaagacccagcacctgagcctgcaggtgcccctgagaagccacagcagcagcagcagcagcgaggagaacagcagcagcagcgccgcccagcccctgctggccggcgagaaggagagccccagcagcgtggccgacgaccacctggtgcagaaggagttcctgcacggcaccaagagagacgacggccaggccagcatccccaccgagatcagcggcaacagccccgtgagccccaacacccaggacaagagcgtgggccagagccccctgagaagccccctgaagagacaggccagcgtgtgcagcaccagactgggcagcaccaagagcctgaccgccgccttctacggcgacaagcagcccgtgaccgtgggcgtgcagttcagcagcgacgtgagcagaagcgacgagaacgtgctggacagccccaagcagagaagaagcttcggcagcttcccctacacccccagcgccgacagcaacagcttccaccagtacagaagcatggacagcagcatgagcatggccgacagcgaggcctacttcagcgccgccgaggagttcgagcccatcagcagcgacgagggccccggcacctaccccggcagaaagaagaagaagaagcagacccagcagatcgactacagcagaggcagcatctaccacagcgtggagggccccctgaccggccacggcgagagcatccaggacagcagaaccctgcccttcaagacccaccccagccaggccagcttcgtgagcgccctgggcggcgaggacgacgtgatcgagcacctgtacatcgtggagggcgagaagaccgtggagagcgagcagatcaccccccagcagcccgtgatgaactgctaccagacctacctgacccagttccaggtgatcaactggagcgtgaagcaccccaccaacaagagaaccagcaagagcagcctgcacagacccctggacctggacacccccaccagcgaggagagcagcagcagcttcgagcagctgagcgtgcccaccttcaaggtgatcaagcagggcctgaccgccaacagcctgctggacagaggcatgcagctgagcggcagcaccagcaacaccccctacacccccctggagaagaagctggccgacaacaccgacgacgagaccctgaccgaggagtggaccctggaccagcccgtgagccagaccagaaccaccgccatcgtggaggtgaagggcaccgtggacatcgtgctgacccccctggtggccgaggccctggacagatacatcgaggccatggtgcactgcgccagcaccagacaccccgccgccatcgtggacgacctgcacgccaaggtgctgagagaggccgtgcagaacagcaagaccaccttcagcgagaacctgagcagcaagcaggacatcagaggcaccaagaccgagcagagcaccatcggcaccaccaaccagggccaggcccagaccaacctgaccatgaagcaggacaacgtgaccatcaagggcctgcagaccaacgtgagcatccccaaggtgaacctgtgcctgctgcaggccagcgtggaggagagccccaccaccgcccccagcagaagcgtgacccacgtgagcctggtggccctgtgcttcgacagaatcgccacccaggtgagaatgaacagaggcgtggtggaggagaccagcaacaacgccgagcccggcagaaccagcaacttcgacagatacgtgcacgccaccaagatgcagccccagagcagcggcagcctgagaagcaacgccggcgccgagaagggcaaggagatcgccgccaagctgaacatccacagagtgcacggccagctgagaggcctggacaccaccgacatcggcacctgcgccatcaccgccatccccttcgagaagagcaaggtgctgttcaccctggaggagctggacgagttcaccttcgtggacgagaccgaccagcaggccgtgcccgacgtgaccagaatcggccccagccaggagaagtggggctggatcatgttcgagtgcggcctggagaacctgaccatcaagggcggcagacagagcggcgccgtgctgtacaacagcttcggcatcatgggcaaggccagcgacaccgagagaggcggcgtgctgaccagcaacaacagcagcgacagccccaccggcagcggctacaacaccgacgtgagcgacgacaacctgccctgcgacagaaccagccccagcagcgacctgaacggcaacagcgtgagcgacgagcaggacgagggcgtggagagcgacgacctgaagaaggacctgcccctgatgccccccccccccgacagctgcagcatgaagctgaccatcaaggagatctggttcagcttcgccgcccccaccaacgtgagaagccacacccacgccttcagcagacagctgaacctgctgagcaccgccacccccgccgtgggcgcctggctggtgcccatcgaccagctgaagagcagcctgaacaagctggagaccgagggcaccctgagaatctgcgccgtgatgggctgcatcatgaccgaggccctggagaacaagagcgtgcacttccccctgagaagcaagtacaacagactgaccaaggtggccagattcctgcaggagaaccccagctgcctgctgtgcaacatcctgcaccactacctgcaccaggccaactacagcatcatcgacgacgccaccatgagcgacggcctgcccgccctggtgaccctgaagaagggcctggtggccctggccagacagtggatgaagttcatcgtggtgacccccgccttcaagggcgtgagcctgcacagacccgcccagcccctgaagccccagatcgccatggaccacgagcacgaggacggcctgggcctggacaacggcggcggcctgcagagcgacaccagcgccgacggcgccgagttcgagttcgacgccgccaccgtgagcgagcacaccatgctgctggagggcaccgccaacagacccccccccggcagcagcggccccgtgaccggcgccgagatcatgagaaagctgagcaagacccacacccacagcgacagcgccctgaagatcaagggcatccacccctaccacagcctgagctacaccagcggcgacaccgccaccgacagccccgtgcacgtgggcagagccggcatgcccgtgaaggacagccccagaaaggagagcctgctgagctacctgaccggcagcttccccagcctgcacaacctgctggagggcaccccccagagaagcagcgccgccgtgaagagcagcagcctgaccagaaccggcaacaccgtggccaccgacatgctgagcgagcaccccctgctgagcgagcccagcagcgtgagcttctacaactggatgagcaacgccgtgggcaacagaggcagcgtgctgcaggagagccccgtgaccaagagcggccacaacagcctgcccaccggcgtggcccccaacctgcccaccatccccagcgccagcgacttcaacaccgtgctgagcagcgaccagaacaccctggacggcacccacagccagcacagcaccagccaggacgacgtggccggcgtggaggaggccaaccagggcttccccgccgtgcagctggccgacgcccaggtggtgttcaagcccctgctgagccacaccggcatccagagccaggacaccatgcccttctgctacagaatgtacttcggcgagcacctgagcttcagcggcaccctggactgcctgagagccgacatcgtggacagcgacaccgccaaggagagaaagggcaagagagccagaagacagggccacgtgaacctgccccccctggagttcaagcccgccctgatgctgggcaccttcagcatcagcgccgtggtgatggagaagagcgtgtgcaccccccagaacagcaccagcgccctgagcttccacgacctgagcaagagatactacaacaccttccactgcaacttcaccatcagctgccagagcatcagccagcacgtggacatggccctggtgagactgatccaccagttcagcaccatgatcgacgacatcaaggccacccagaccgacatcaagctgagcagatacaccgccggcagcgccagccccacccccaccttcaagaccagaaagcacagagacttcagaagcagcgacttcagcagaagcagcagaggcagcctgaacggcggcaacagagtgaacaacgccaagaacaagagaaccaacaacgagaacaacaagaaggagagcagaaacaagaacagcctgggcagaagcgagagaagaaccagcaaggtgagcagaaagggcagcaaggacgtggtggaccacatgaccatccacatggacgacagcgacagcatcaccgtgagcgagcagagcgagcccagcgccgagtgctggcagaacatgtacaagctgctgaacttctacagcctgatcagcgaccccaccggcatcctggagaagagcagcgagaccttcggccccgccggcgtgagaagccccaccgagcccacctgcaaggtggtgttcgagaacgagcaggacaacagcagcctgaccaagacccagagaaagagaagcctggtgaccagcgagccccagcacgtgaccctgatcgtgttcggcatcggcatggtgaacagaacccacctggaggccgacatcggcggcctgaccatggagagcgagctgaagagaatccacggcagcttcaccctgaaggagaagatgaaggacgtgctgcaccagaagatgaccgagacctgcgccaccgcccacatcggcggcgtgaacatcgtgctgctggagggcatcacccccaacatccagctggaggacttccccaccagccccaccagcaccgccaagcaggagttcctgaccgtggtgaagtgcagcatcgccaagagccaggccctgtacagcgcccagagaggcctgaagaccaacaacgccgccgtgttcaaggtgggcgccatcagcatcaacatcccccagcaccccgccaccctgcacagcatgatggtgagaagcagccaccagctgagcaagcagatcagcgacctgatcagacagcccagcaccgccccccagcccgtgaaggaggacatcgccacccccctgcccagcgagaagacccccaccagcgtgaaccagacccccgtggagaccaacgagttcccccagctgcccgagggcctggagaagaagcccatcgtgctgaagttcagcgccatgctggacggcatcgccatcggcgccgccctgctgcccagcctgaaggccgagtacaagatgggcagaatgagaagccacggcatgaccggcgcccagaccagattcaccttcgagctgcccaaccacagactgagattcaccagcaaggtgagcgccaccgacatgagcaccatcccccccagcgccagcctgaacctgccccccgtgaccatgagcggcaagtacatcatggaggagcacgacagctacagcgaccaggtgtggagcatcgacgagctgcccagcaagcagggctactacctgcagggcaactacctgagatgcgtggccgaggtgggcagcttcgagcacaacctgaccaccgacctgctgaaccacctggtgttcgtgcagaaggtgttcatgaaggaggtgaacgaggtgatccagaaggtgagcggcggcgagcagcccatccccctgtggaacgagcacgacggcaccgccgacggcgacaagcccaagatcctgctgtacagcctgaacctgcagttcaagggcatccaggtgaccgccaccacccccagcatgagagccgtgagattcgagaccggcctgatcgagctggagctgagcaacagactgcagaccaaggccagccccggcagcagcagctacctgaagctgttcggcaagtgccaggtggacctgaacctggccctgggccagatcgtgaagcaccaggtgtacgaggaggccggcagcgacttccaccaggtggcctacttcaagaccagaatcggcctgagaaacgccctgagagaggagatcagcggcagcagcgacagagaggccgtgctgatcaccctgaacagacccatcgtgtacgcccagcccgtggccttcgacagagccgtgctgttctggctgaactacaaggccgcctacgacaactggaacgagcagagaatggccctgcacaaggacatccacatggccaccaaggaggtggtggacatgctgcccggcatccagcagaccagcgcccaggccttcggcaccctgttcctgcagctgaccgtgaacgacctgggcatctgcctgcccatcaccaacaccgcccagagcaaccacaccggcgacctggacaccggcagcgccctggtgctgaccatcgagagcaccctgatcaccgcctgcagcagcgagagcctggtgagcaagggccacttcaagaacttctgcatcagattcgccgacggcttcgagaccagctgggacgactggaagcccgagatccacggcgacctggtgatgaacgcctgcgtggtgcccgacggcacctacgaggtgtgcagcagaaccaccggccaggccgccgccgagagcagcagcgccggcacctggaccctgaacgtgctgtggaagatgtgcggcatcgacgtgcacatggaccccaacatcggcaagagactgaacgccctgggcaacaccctgaccaccctgaccggcgaggaggacatcgacgacatcgccgacctgaacagcgtgaacatcgccgacctgagcgacgaggacgaggtggacaccatgagccccaccatccacaccgaggccaccgactacagaagacaggccgccagcgccagccagcccggcgagctgagaggcagaaagatcatgaagagaatcgtggacatcagagagctgaacgagcaggccaaggtgatcgacgacctgaagaagctgggcgccagcgagggcaccatcaaccaggagatccagagataccagcagctggagagcgtggccgtgaacgacatcagaagagacgtgagaaagaagctgagaagaagcagcatgagagccgccagcctgaaggacaagtggggcctgagctacaagcccagctacagcagaagcaagagcatcagcgccagcggcagaccccccctgaagagaatggagagagccagcagcagagtgggcgagaccgaggagctgcccgagatcagagtggacgccgccagccccggccccagagtgaccttcaacatccaggacaccatcgccgagatcagaagaaagaagatcagcttcaaggtggtgttctag

SEQ ID NO: 95063 - DNA, 2241 bp, Artificial Sequence
  Description of Artificial Sequence: Synthetic coding sequence
atgccctgcctgggcctgctggccaacctgtgcagacacaacctgagcgtgcagacccacatcaagaccctgagcaacgtgaagagcttctacagaaccctgatcaccctgctggcccacagcagcctgaccgtggtggtgttcgccctgagcatcctgagcagcctgaccctgaacgaggaggtgggcgagaagctgttccacgccagaaacatccaccagaccttccagctgatcttcaacatcctgatcaacggcgacggcaccctgaccagaaagtacagcgtggacctgctgatggacctgctgaagaaccccaagatcgccgactacctgaccagatacgagcacttcagcagctgcctgcaccaggtgctgggcctgctgaacggcaaggaccccgacagcagcagcaaggtgctggagctgctgctggccttctgcagcgtgacccagctgagacacatgctgacccagatgatgttcgagcagagcccccccggcagcgccaccctgggcagccacaccaagtgcctggagcccaccgtggccctgctgagatggctgagccagcccctggacggcagcgagaactgcagcgtgctggccctggagctgttcaaggagatcttcgaggacgtgatcgacgccgccaactgcagcagcgccgacagattcgtgaccctgctgctgcccaccatcctggaccagctgcagttcaccgagcagaacctggacgaggccctgaccagaaagaagtgcgagagaatcgccaaggccatcgaggtgctgctgaccctgtgcggcgacgacaccctgaagatgcacatcgccaagatcctgaccaccgtgaagtgcaccaccctgatcgagcagcagttcacctacggcaagatcgacctgggcttcggcaccaaggtggccgacagcgagctgtgcaagctggccgccgacgtgatcctgaagaccctggacctgatcaacaagctgaagcccctggtgcccggcatggaggtgagcttctacaagatcctgcaggaccccagactgatcacccccctggccttcgccctgaccagcgacaacagagagcaggtgcagagcggcctgagaatcctgctggaggccgcccccctgcccgacttccccgccctggtgctgggcgagagcatcgccgccaacaacgcctacagacagcaggagaccgagcacatccccagaaagatgccctggcagagcagcaaccacagcttccccaccagcatcaagtgcctgaccccccacctgaaggacggcgtgcccggcctgaacatcgaggagctgatcgagaagctgcagagcggcatggtggtgaaggaccagatctgcgacgtgagaatcagcgacatcatggacgtgtacgagatgaagctgagcaccctggccagcaaggagagcagactgcaggacctgctggagaccaaggccctggccctggcccaggccgacagactgatcgcccagcacagatgccagagaacccaggccgagaccgaggccagaaccctggccagcatgctgagagaggtggagagaaagaacgaggagctgagcgtgctgctgaaggcccagcaggtggagagcgagagagcccagagcgacatcgagcacctgttccagcacaacagaaagctggagagcgtggccgaggagcacgagatcctgaccaagagctacatggagctgctgcagagaaacgagagcaccgagaagaagaacaaggacctgcagatcacctgcgacagcctgaacaagcagatcgagaccgtgaagaagctgaacgagagcctgaaggagcagaacgagaagagcatcgcccagctgatcgagaaggaggagcagagaaaggaggtgcagaaccagctggtggacagagagcacaagctggccaacctgcaccagaagaccaaggtgcaggaggagaagatcaagaccctgcagaaggagagagaggacaaggaggagaccatcgacatcctgagaaaggagctgagcagaaccgagcagatcagaaaggagctgagcatcaaggccagcagcctggaggtgcagaaggcccagctggagggcagactggaggagaaggagagcctggtgaagctgcagcaggaggagctgaacaagcacagccacatgatcgccatgatccacagcctgagcggcggcaagatcaaccccgagaccgtgaacctgagcatctag

SEQ ID NO: 95064 - DNA, 840 bp, Artificial Sequence
  Description of Artificial Sequence: Synthetic coding sequence
atgaccctgcccttcttcgccttccccctgatcatctggagcatcagaaccgtgatcatcttcttcttcagcaagagaaccgagagaaacaacgaggccctggacgacctgaagagccagagaaagaagatcctggaggaggtgatggagaaggagacctacaagaccgccaagctgatcctggagagattcgaccccgacagcaagaaggccaaggagtgcgagccccccagcgccggcgccgccgtgaccgccagacccggccaggagatcagacagagaaccgccgcccagagaaacctgagccccacccccgccagccccaaccagggcccccccccccaggtgcccgtgagccccggcccccccaaggacagcagcgcccccggcggcccccccgagagaaccgtgacccccgccctgagcagcaacgtgctgcccagacacctgggcagccccgccaccagcgtgcccggcatgggcctgcacccccccggcccccccctggccagacccatcctgcccagagagagaggcgccctggacagaatcgtggagtacctggtgggcgacggcccccagaacagatacgccctgatctgccagcagtgcttcagccacaacggcatggccctgaaggaggagttcgagtacatcgccttcagatgcgcctactgcttcttcctgaaccccgccagaaagaccagaccccaggcccccagactgcccgagttcagcttcgagaagagacaggtggtggagggcagcagcagcgtgggccccctgcccagcggcagcgtgctgagcagcgacaaccagttcaacgaggtgcagtactag

SEQ ID NO: 95065 - DNA, 3192 bp, Artificial Sequence
  Description of Artificial Sequence: Synthetic coding sequence
atgaccagactgggctggcccagcccctgctgcgccagaaagcagtgcagcgagggcagaacctacagcaacgccgtgatcagccccaacctggagaccaccagaatcatgagagtgagccacaccttccccgtggtggactgcaccgccgcctgctgcgacctgagcagctgcgacctggcctggtggttcgagggcagatgctacctggtgagctgcccccacaaggagaactgcgagcccaagaagatgggccccatcagaagctacctgaccttcgtgctgagacccgtgcagagacccgcccagctgctggactacggcgacatgatgctgaacagaggcagccccagcggcatctggggcgacagccccgaggacatcagaaaggacctgaccttcctgggcaaggactggggcctggaggagatgagcgagtacagcgacgactacagagagctggagaaggacctgctgcagcccagcggcaagcaggagcccagaggcagcgccgagtacaccgactggggcctgctgcccggcagcgagggcgccttcaacagcagcgtgggcgacagccccgccgtgcccgccgagacccagcaggaccccgagctgcactacctgaacgagagcgccagcacccccgcccccaagctgcccgagagaagcgtgctgctgcccctgcccaccacccccagcagcggcgaggtgctggagaaggagaaggccagccagctgcaggagcagagcagcaacagcagcggcaaggaggtgctgatgcccagccacagcctgccccccgccagcctggagctgagcagcgtgaccgtggagaagagccccgtgctgaccgtgacccccggcagcaccgagcacagcatccccaccccccccaccagcgccgcccccagcgagagcacccccagcgagctgcccatcagccccaccaccgcccccagaaccgtgaaggagctgaccgtgagcgccggcgacaacctgatcatcaccctgcccgacaacgaggtggagctgaaggccttcgtggcccccgccccccccgtggagaccacctacaactacgagtggaacctgatcagccaccccaccgactaccagggcgagatcaagcagggccacaagcagaccctgaacctgagccagctgagcgtgggcctgtacgtgttcaaggtgaccgtgagcagcgagaacgccttcggcgagggcttcgtgaacgtgaccgtgaagcccgccagaagagtgaacctgccccccgtggccgtggtgagcccccagctgcaggagctgaccctgcccctgaccagcgccctgatcgacggcagccagagcaccgacgacaccgagatcgtgagctaccactgggaggagatcaacggccccttcatcgaggagaagaccagcgtggacagccccgtgctgagactgagcaacctggaccccggcaactacagcttcagactgaccgtgaccgacagcgacggcgccaccaacagcaccaccgccgccctgatcgtgaacaacgccgtggactacccccccgtggccaacgccggccccaaccacaccatcaccctgccccagaacagcatcaccctgaacggcaaccagagcagcgacgaccaccagatcgtgctgtacgagtggagcctgggccccggcagcgagggcaagcacgtggtgatgcagggcgtgcagaccccctacctgcacctgagcgccatgcaggagggcgactacaccttccagctgaaggtgaccgacagcagcagacagcagagcaccgccgtggtgaccgtgatcgtgcagcccgagaacaacagaccccccgtggccgtggccggccccgacaaggagctgatcttccccgtggagagcgccaccctggacggcagcagcagcagcgacgaccacggcatcgtgttctaccactgggagcacgtgagaggccccagcgccgtggagatggagaacatcgacaaggccatcgccaccgtgaccggcctgcaggtgggcacctaccacttcagactgaccgtgaaggaccagcagggcctgagcagcaccagcaccctgaccgtggccgtgaagaaggagaacaacagcccccccagagccagagccggcggcagacacgtgctggtgctgcccaacaacagcatcaccctggacggcagcagaagcaccgacgaccagagaatcgtgagctacctgtggatcagagacggccagagccccgccgccggcgacgtgatcgacggcagcgaccacagcgtggccctgcagctgaccaacctggtggagggcgtgtacaccttccacctgagagtgaccgacagccagggcgccagcgacaccgacaccgccaccgtggaggtgcagcccgaccccagaaagagcggcctggtggagctgaccctgcaggtgggcgtgggccagctgaccgagcagagaaaggacaccctggtgagacagctggccgtgctgctgaacgtgctggacagcgacatcaaggtgcagaagatcagagcccacagcgacctgagcaccgtgatcgtgttctacgtgcagagcagaccccccttcaaggtgctgaaggccgccgaggtggccagaaacctgcacatgagactgagcaaggagaaggccgacttcctgctgttcaaggtgctgagagtggacaccgccggctgcctgctgaagtgcagcggccacggccactgcgaccccctgaccaagagatgcatctgcagccacctgtggatggagaacctgatccagagatacatctgggacggcgagagcaactgcgagtggagcatcttctacgtgaccgtgctggccttcaccctgatcgtgctgaccggcggcttcacctggctgtgcatctgctgctgcaagagacagaagagaaccaagatcagaaagaagaccaagtacaccatcctggacaacatggacgagcaggagagaatggagctgagacccaagtacggcatcaagcacagaagcaccgagcacaacagcagcctgatggtgagcgagagcgagttcgacagcgaccaggacaccatcttcagcagagagaagatggagagaggcaaccccaaggtgagcatgaacggcagcatcagaaacggcgccagcttcagctactgcagcaaggacagatag

SEQ ID NO: 95066 - DNA, 1293 bp, Artificial Sequence
  Description of Artificial Sequence: Synthetic coding sequence
atgggcagaagctggcccggcctgagcctgtgccagtggagactgctgcccgccctggaggccggctgggccgtggccgccgagaccggcggcggcggcagacccggcagagccgcccccgccagctgcagctgcgagttcctgtggaccatcgacgacatctaccactgcgcccagttcctgcagatcaaggacggctggatcatcttcagcatggaggccagactggccatgaccctgcccttcttcgccttccccctgatcatctggagcatcagaaccgtgatcatcttcttcttcagcaagagaaccgagagaaacaacgaggccctggacgacctgaagagccagagaaagaagatcctggaggaggtgatggagaaggagacctacaagaccgccaagctgatcctggagagattcgaccccgacagcaagaaggccaaggagtgcgagccccccagcgccggcgccgccgtgaccgccagacccggccaggagatcagacagagaaccgccgcccagagaaacctgagccccacccccgccagccccaaccagggcccccccccccaggtgcccgtgagccccggcccccccaaggacagcagcgcccccggcggcccccccgagagaaccgtgacccccgccctgagcagcaacgtgctgcccagacacctgggcagccccgccaccagcgtgcccggcatgggcctgcacccccccggcccccccctggccagacccatcctgcccagagagagaggcgccctggacagaatcgtggagtacctggtgggcgacggcccccagaacagatacgccctgatctgccagcagtgcttcagccacaacggcatggccctgaaggaggagttcgagtacatcgccttcagatgcgcctactgcttcttcctgaaccccgccagaaagaccagaccccaggcccccagactgcccgagttcagcttcgagaagagacaggtggtggagggcagcagcagcgtgggccccctgcccagcggcagcgtgctgagcagcgacaaccagttcaacgaggagagcctggagcacgacgtgctggacgacaacaccgagcagaccgacgacaagatccccgccaccgagcagaccaaccaggtgatcgagaaggccagcgacagcgaggagcccgaggagaagcaggagaccgagaacgaggaggccagcgtgatcgagaccaacagcaccgtgcccggcgccgacagcatccccgaccccgagctgagcggcgagagcctgaccgccgagtag

SEQ ID NO: 95067 - DNA, 3036 bp, Artificial Sequence
  Description of Artificial Sequence: Synthetic coding sequence
atggccccccccaccggcgtgctgagcagcctgctgctgctggtgaccatcgccggctgcgccagaaagcagtgcagcgagggcagaacctacagcaacgccgtgatcagccccaacctggagaccaccagaatcatgagagtgagccacaccttccccgtggtggactgcaccgccgcctgctgcgacctgagcagctgcgacctggcctggtggttcgagggcagatgctacctggtgagctgcccccacaaggagaactgcgagcccaagaagatgggccccatcagaagctacctgaccttcgtgctgagacccgtgcagagacccgcccagctgctggactacggcgacatgatgctgaacagaggcagccccagcggcatctggggcgacagccccgaggacatcagaaaggacctgaccttcctgggcaaggactggggcctggaggagatgagcgagtacagcgacgactacagagagctggagaaggacctgctgcagcccagcggcaagcaggagcccagaggcagcgccgagtacaccgactggggcctgctgcccggcagcgagggcgccttcaacagcagcgtgggcgacagccccgccgtgcccgccgagacccagcaggaccccgagctgcactacctgaacgagagcgccagcacccccgcccccaagctgcccgagagaagcgtgctgctgcccctgcccaccacccccagcagcggcgaggtgctggagaaggagaaggccagccagctgcaggagcagagcagcaacagcagcggcaaggaggtgctgatgcccagccacagcctgccccccgccagcctggagctgagcagcgtgaccgtggagaagagccccgtgctgaccgtgacccccggcagcaccgagcacagcatccccaccccccccaccagcgccgcccccagcgagagcacccccagcgagctgcccatcagccccaccaccgcccccagaaccgtgaaggagctgaccgtgagcgccggcgacaacctgatcatcaccctgcccgacaacgaggtggagctgaaggccttcgtggcccccgccccccccgtggagaccacctacaactacgagtggaacctgatcagccaccccaccgactaccagggcgagatcaagcagggccacaagcagaccctgaacctgagccagctgagcgtgggcctgtacgtgttcaaggtgaccgtgagcagcgagaacgccttcggcgagggcttcgtgaacgtgaccgtgaagcccgccagaagagtgaacctgccccccgtggccgtggtgagcccccagctgcaggagctgaccctgcccctgaccagcgccctgatcgacggcagccagagcaccgacgacaccgagatcgtgagctaccactgggaggagatcaacggccccttcatcgaggagaagaccagcgtggacagccccgtgctgagactgagcaacctggaccccggcaactacagcttcagactgaccgtgaccgacagcgacggcgccaccaacagcaccaccgccgccctgatcgtgaacaacgccgtggactacccccccgtggccaacgccggccccaaccacaccatcaccctgccccagaacagcatcaccctgaacggcaaccagagcagcgacgaccaccagatcgtgctgtacgagtggagcctgggccccggcagcgagggcaagcacgtggtgatgcagggcgtgcagaccccctacctgcacctgagcgccatgcaggagggcgactacaccttccagctgaaggtgaccgacagcagcagacagcagagcaccgccgtggtgaccgtgatcgtgcagcccgagaacaacagaccccccgtggccgtggccggccccgacaaggagctgatcttccccgtggagagcgccaccctggacggcagcagcagcagcgacgaccacggcatcgtgttctaccactgggagcacgtgagaggccccagcgccgtggagatggagaacatcgacaaggccatcgccaccgtgaccggcctgcaggtgggcacctaccacttcagactgaccgtgaaggaccagcagggcctgagcagcaccagcaccctgaccgtggccgtgaagaaggagaacaacagcccccccagagccagagccggcggcagacacgtgctggtgctgcccaacaacagcatcaccctggacggcagcagaagcaccgacgaccagagaatcgtgagctacctgtggatcagagacggccagagccccgccgccggcgacgtgatcgacggcagcgaccacagcgtggccctgcagctgaccaacctggtggagggcgtgtacaccttccacctgagagtgaccgacagccagggcgccagcgacaccgacaccgccaccgtggaggtgcagcccgaccccagaaagagcggcctggtggagctgaccctgcaggtgggcgtgggccagctgaccgagcagagaaaggacaccctggtgagacagctggccgtgctgctgaacgtgctggacagcgacatcaaggtgcagaagatcagagcccacagcgacctgagcaccgtgatcgtgttctacgtgcagagcagaccccccttcaaggtgctgaaggccgccgaggtggccagaaacctgcacatgagactgagcaaggagaaggccgacttcctgctgttcaaggtgctgagagtggacaccgccggctgcctgctgaagtgcagcggccacggccactgcgaccccctgaccaagagatgcatctgcagccacctgtggatggagaacctgatccagagatacatctgggacggcgagagcaactgcggcatcaagcacagaagcaccgagcacaacagcagcctgatggtgagcgagagcgagttcgacagcgaccaggacaccatcttcagcagagagaagatggagagaggcaaccccaaggtgagcatgaacggcagcatcagaaacggcgccagcttcagctactgcagcaaggacagatag

SEQ ID NO: 95068 - DNA, 1206 bp, Artificial Sequence
  Description of Artificial Sequence: Synthetic coding sequence
atggagacccccgaggtgcccgtgggcagcctgatcgacttcggccccgaggcccccaccagcagccccctggaggcccccccccccgtgctgcaggacggcgacggcagcctgggcgacggcgccagcgagagcgagaccaccgagagcgccgacagcgagaacgacatgggcgagagccccagccaccccagctgggaccaggacagaagaagcagcagcaacgagagcttcagcagcaaccagagcaccgagagcacccaggacgaggagaccctggccctgagagacttcatgagaggctacgtggagaagatcttcagcggcggcgaggacctggaccaggaggagaaggccaagttcggcgagtactgcagcagcgagaacggcaagggcagagagtggttcgccagatacgtgagcgcccagagatgcaacagcaagtgcgtgagcgaggccaccttctacagactggtgcagagcttcgccgtggtgctgttcgagtgccaccagatggacgacttcggccccgccaagaacctgatgaccatgtgcttcacctactaccacatcggcaagccccagctgctgccccccgagagcagagagaagcccgccggcagcatcgacagctacctgaagagcgccaacagctggctggccgagaagaaggacatcgccgagagactgctgaagaacaccagcgccagaaccgagaacgtgaagggcttcttcggcggcctggagaccaagctgaagggccccctggccagaagaaacgaggaggacgagaacaagccccaggagaagagacccagagccgtgaccgcctacagccccgaggacgagaagaagggcgagaagatctacctgtacacccacctgaagcagcagcccatctggcacaccctgagattctggaacgccgccttcttcgacgccgtgcactgcgagagaaccaagagaagccccaccaccagagagaagtggtgccacatgacccaggaggagagagacgacagcctgagattcaacgagaacatcaccttcggccagctgggcaccttcacccacaacatgctggccttcggcctgaacaagaagctgtgcaacgacttcctgaagaagcaggccgtgatcggcaacctggacgaggagcagtacaagctgctgagcgaccacatcgagcagatggccaccgagtag

SEQ ID NO: 95069 - DNA, 3219 bp, Artificial Sequence; identical to SEQ ID NO: 95043
  Description of Artificial Sequence: Synthetic coding sequence

SEQ ID NO: 95070 - DNA, 1380 bp, Artificial Sequence
  Description of Artificial Sequence: Synthetic coding sequence
atgggcggcctgttcagcagatggagaaccaagcccagcaccgtggaggtgctggagagcatcgacaaggagatccaggccctggaggagttcagagagaagaaccagagactgcagaagctgtgggtgggcagactgatcctgtacagcagcgtgctgtacctgttcacctgcctgatcgtgtacctgtggtacctgcccgacgagttcaccgccagactggccatgaccctgcccttcttcgccttccccctgatcatctggagcatcagaaccgtgatcatcttcttcttcagcaagagaaccgagagaaacaacgaggccctggacgacctgaagagccagagaaagaagatcctggaggaggtgatggagaaggagacctacaagaccgccaagctgatcctggagagattcgaccccgacagcaagaaggccaaggagtgcgagccccccagcgccggcgccgccgtgaccgccagacccggccaggagatcagacagagaaccgccgcccagagaaacctgagccccacccccgccagccccaaccagggcccccccccccaggtgcccgtgagccccggcccccccaaggacagcagcgcccccggcggcccccccgagagaaccgtgacccccgccctgagcagcaacgtgctgcccagacacctgggcagccccgccaccagcgtgcccggcatggagatgggcctgccccacatcgcccaggccggcctggagcacctgagcagcagcgacctgagcaccagcaccagccagagcgccggcatcaccggcctgcacccccccggcccccccctggccagacccatcctgcccagagagagaggcgccctggacagaatcgtggagtacctggtgggcgacggcccccagaacagatacgccctgatctgccagcagtgcttcagccacaacggcatggccctgaaggaggagttcgagtacatcgccttcagatgcgcctactgcttcttcctgaaccccgccagaaagaccagaccccaggcccccagactgcccgagttcagcttcgagaagagacaggtggtggagggcagcagcagcgtgggccccctgcccagcggcagcgtgctgagcagcgacaaccagttcaacgaggagagcctggagcacgacgtgctggacgacaacaccgagcagaccgacgacaagatccccgccaccgagcagaccaaccaggtgatcgagaaggccagcgacagcgaggagcccgaggagaagcaggagaccgagaacgaggaggccagcgtgatcgagaccaacagcaccgtgcccggcgccgacagcatccccgaccccgagctgagcggcgagagcctgaccgccgagtag

SEQ ID NO: 95071 - DNA, 240 bp, Artificial Sequence
  Description of Artificial Sequence: Synthetic coding sequence
atgcaccccgacctgagcccccacctgcacaccgaggagtgcaacgtgctgatcaacctgctgaaggagtgccacaagaaccacaacatcctgaagttcttcggctactgcaacgacgtggacagagagctgagaaagtgcctgaagaacgagtacgtggagaacagaaccaagagcagagagcacggcatcgccatgagaaagaagctgttcaacccccccgaggagagcgagaagtag

SEQ ID NO: 95072 - DNA, 1569 bp, Artificial Sequence
  Description of Artificial Sequence: Synthetic coding sequence
atgagcagacagctgctgcccgtgctgctgctgctgctgctgagagccagctgcccctggggccaggagcagggcgccagaagccccagcgaggagccccccgaggaggagatccccaaggaggacggcatcctggtgctgagcagacacaccctgggcctggccctgagagagcaccccgccctgctggtggagttctacgccccctggtgcggccactgccaggccctggcccccgagtacagcaaggccgccgccgtgctggccgccgagagcatggtggtgaccctggccaaggtggacggccccgcccagagagagctggccgaggagttcggcgtgaccgagtaccccaccctgaagttcttcagaaacggcaacagaacccaccccgaggagtacaccggccccagagacgccgagggcatcgccgagtggctgagaagaagagtgggccccagcgccatgagactggaggacgaggccgccgcccaggccctgatcggcggcagagacctggtggtgatcggcttcttccaggacgaggacgtggccaccttcctggccctggcccaggacgccctggacatgaccttcggcctgaccgacagacccagactgttccagcagttcggcctgaccaaggacaccgtggtgctgttcaagaagttcgacgagggcagagccgacttccccgtggacgaggagctgggcctggacctgggcgacctgagcagattcctggtgacccacagcatgagactggtgaccgagttcaacagccagaccagcgccaagatcttcgccgccagaatcctgaaccacctgctgctgttcgtgaaccagaccctggccgcccacagagagctgctggccggcttcggcgaggccgcccccagattcagaggccaggtgctgttcgtggtggtggacgtggccgccgacaacgagcacgtgctgcagtacttcggcctgaaggccgaggccgcccccaccctgagactggtgaacctggagaccaccaagaagtacgcccccgtggacggcggccccgtgaccgccgccagcatcaccgccttctgccacgccgtgctgaacggccaggtgaagccctacctgctgagccaggagatcccccccgactgggaccagagacccgtgaagaccctggtgggcaagaacttcgagcaggtggccttcgacgagaccaagaacgtgttcgtgaagttctacgccccctggtgcacccactgcaaggagatggcccccgcctgggaggccctggccgagaagtaccaggaccacgaggacatcatcatcgccgagctggacgccaccgccaacgagctggacgccttcgccgtgcacggcttccccaccctgaagtacttccccgccggccccggcagaaaggtgatcgagtacaagagcaccagagacctggagaccttcagcaagttcctggacaacggcggcgtgctgcccaccgaggagccccccgaggagcccgccgcccccttccccgagccccccgccaacagcaccatgggcagcaaggaggagctgtag

SEQ ID NO: 95073 - DNA, 1485 bp, Artificial Sequence
  Description of Artificial Sequence: Synthetic coding sequence
atgggcagcggcaccggcagcgaggagcccctgggcggcgccagcagaggcggcaacccccagggcggctgggacctgggcgccgagcccccccaccccggccccggccccgccggcgccccctgccccgccggcggcatcctgtgccccgtggtgtgggccctgcccggccccggccccagagtgcagcagggcagctgcagagccagaggcagagtgaacggcggccacgccgaggagttcggcgtgaccgagtaccccaccctgaagttcttcagaaacggcaacagaacccaccccgaggagtacaccggccccagagacgccgagggcatcgccgagtggctgagaagaagagtgggccccagcgccatgagactggaggacgaggccgccgcccaggccctgatcggcggcagagacctggtggtgatcggcttcttccaggacctgcaggacgaggacgtggccaccttcctggccctggcccaggacgccctggacatgaccttcggcctgaccgacagacccagactgttccagcagttcggcctgaccaaggacaccgtggtgctgttcaagaagttcgacgagggcagagccgacttccccgtggacgaggagctgggcctggacctgggcgacctgagcagattcctggtgacccacagcatgagactggtgaccgagttcaacagccagaccagcgccaagatcttcgccgccagaatcctgaaccacctgctgctgttcgtgaaccagaccctggccgcccacagagagctgctggccggcttcggcgaggccgcccccagattcagaggccaggtgctgttcgtggtggtggacgtggccgccgacaacgagcacgtgctgcagtacttcggcctgaaggccgaggccgcccccaccctgagactggtgaacctggagaccaccaagaagtacgcccccgtggacggcggccccgtgaccgccgccagcatcaccgccttctgccacgccgtgctgaacggccaggtgaagccctacctgctgagccaggagatcccccccgactgggaccagagacccgtgaagaccctggtgggcaagaacttcgagcaggtggccttcgacgagaccaagaacgtgttcgtgaagttctacgccccctggtgcacccactgcaaggagatggcccccgcctgggaggccctggccgagaagtaccaggaccacgaggacatcatcatcgccgagctggacgccaccgccaacgagctggacgccttcgccgtgcacggcttccccaccctgaagtacttccccgccggccccggcagaaaggtgatcgagtacaagagcaccagagacctggagaccttcagcaagttcctggacaacggcggcgtgctgcccaccgaggagccccccgaggagcccgccgcccccttccccgagccccccgccaacagcaccatgggcagcaaggaggagctgtag

SEQ ID NO: 95074 - DNA, 1323 bp, Artificial Sequence
  Description of Artificial Sequence: Synthetic coding sequence
atggccctgctggtgctgggcctggtgagctgcaccttcttcctggccgtgaacggcctgtacagcagcagcgacgacgtgatcgagctgacccccagcaacttcaacagagaggtgatccagagcgacagcctgtggctggtggagttctacgccccctggtgcggccactgccagagactgacccccgagtggaagaaggccgccaccgccctgaaggacgtggtgaaggtgggcgccgtggacgccgacaagcaccacagcctgggcggccagtacggcgtgcagggcttccccaccatcaagatcttcggcagcaacaagaacagacccgaggactaccagggcggcagaaccggcgaggccatcgtggacgccgccctgagcgccctgagacagctggtgaaggacagactgggcggcagaagcggcggctacagcagcggcaagcagggcagaagcgacagcagcagcaagaaggacgtgatcgagctgaccgacgacagcttcgacaagaacgtgctggacagcgaggacgtgtggatggtggagttctacgccccctggtgcggccactgcaagaacctggagcccgagtgggccgccgccgccagcgaggtgaaggagcagaccaagggcaaggtgaagctggccgccgtggacgccaccgtgaaccaggtgctggccagcagatacggcatcagaggcttccccaccatcaagatcttccagaagggcgagagccccgtggactacgacggcggcagaaccagaagcgacatcgtgagcagagccctggacctgttcagcgacaacgcccccccccccgagctgctggagatcatcaacgaggacatcgccaagagaacctgcgaggagcaccagctgtgcgtggtggccgtgctgccccacatcctggacaccggcgccgccggcagaaacagctacctggaggtgctgctgaagctggccgacaagtacaagaagaagatgtggggctggctgtggaccgaggccggcgcccagagcgagctggagaccgccctgggcatcggcggcttcggctaccccgccatggccgccatcaacgccagaaagatgaagttcgccctgctgaagggcagcttcagcgagcagggcatcaacgagttcctgagagagctgagcttcggcagaggcagcaccgcccccgtgggcggcggcgccttccccaccatcgtggagagagagccctgggacggcagagacggcgagctgcccgtggaggacgacatcgacctgagcgacgtggagctggacgacctgggcaaggacgagctgtag

SEQ ID NO: 95075 - DNA, 1338 bp, Artificial Sequence
  Description of Artificial Sequence: Synthetic coding sequence
atgtaccccagcaccaccatggccaacgcccccggcctggtgagctgcaccttcttcctggccgtgaacggcctgtacagcagcagcgacgacgtgatcgagctgacccccagcaacttcaacagagaggtgatccagagcgacagcctgtggctggtggagttctacgccccctggtgcggccactgccagagactgacccccgagtggaagaaggccgccaccgccctgaaggacgtggtgaaggtgggcgccgtggacgccgacaagcaccacagcctgggcggccagtacggcgtgcagggcttccccaccatcaagatcttcggcagcaacaagaacagacccgaggactaccagggcggcagaaccggcgaggccatcgtggacgccgccctgagcgccctgagacagctggtgaaggacagactgggcggcagaagcggcggctacagcagcggcaagcagggcagaagcgacagcagcagcaagaaggacgtgatcgagctgaccgacgacagcttcgacaagaacgtgctggacagcgaggacgtgtggatggtggagttctacgccccctggtgcggccactgcaagaacctggagcccgagtgggccgccgccgccagcgaggtgaaggagcagaccaagggcaaggtgaagctggccgccgtggacgccaccgtgaaccaggtgctggccagcagatacggcatcagaggcttccccaccatcaagatcttccagaagggcgagagccccgtggactacgacggcggcagaaccagaagcgacatcgtgagcagagccctggacctgttcagcgacaacgcccccccccccgagctgctggagatcatcaacgaggacatcgccaagagaacctgcgaggagcaccagctgtgcgtggtggccgtgctgccccacatcctggacaccggcgccgccggcagaaacagctacctggaggtgctgctgaagctggccgacaagtacaagaagaagatgtggggctggctgtggaccgaggccggcgcccagagcgagctggagaccgccctgggcatcggcggcttcggctaccccgccatggccgccatcaacgccagaaagatgaagttcgccctgctgaagggcagcttcagcgagcagggcatcaacgagttcctgagagagctgagcttcggcagaggcagcaccgcccccgtgggcggcggcgccttccccaccatcgtggagagagagccctgggacggcagagacggcgagctgcccgtggaggacgacatcgacctgagcgacgtggagctggacgacctgggcaaggacgagctgtag

SEQ ID NO: 95076 - DNA, 36 bp, Artificial Sequence
  Description of Artificial Sequence: Synthetic coding sequence
atgtaccccagcaccaccatggccaacgccccctag

SEQ ID NO: 95077 - DNA, 1314 bp, Artificial Sequence
  Description of Artificial Sequence: Synthetic coding sequence
atgatcctgggcctggtgagctgcaccttcttcctggccgtgaacggcctgtacagcagcagcgacgacgtgatcgagctgacccccagcaacttcaacagagaggtgatccagagcgacagcctgtggctggtggagttctacgccccctggtgcggccactgccagagactgacccccgagtggaagaaggccgccaccgccctgaaggacgtggtgaaggtgggcgccgtggacgccgacaagcaccacagcctgggcggccagtacggcgtgcagggcttccccaccatcaagatcttcggcagcaacaagaacagacccgaggactaccagggcggcagaaccggcgaggccatcgtggacgccgccctgagcgccctgagacagctggtgaaggacagactgggcggcagaagcggcggctacagcagcggcaagcagggcagaagcgacagcagcagcaagaaggacgtgatcgagctgaccgacgacagcttcgacaagaacgtgctggacagcgaggacgtgtggatggtggagttctacgccccctggtgcggccactgcaagaacctggagcccgagtgggccgccgccgccagcgaggtgaaggagcagaccaagggcaaggtgaagctggccgccgtggacgccaccgtgaaccaggtgctggccagcagatacggcatcagaggcttccccaccatcaagatcttccagaagggcgagagccccgtggactacgacggcggcagaaccagaagcgacatcgtgagcagagccctggacctgttcagcgacaacgcccccccccccgagctgctggagatcatcaacgaggacatcgccaagagaacctgcgaggagcaccagctgtgcgtggtggccgtgctgccccacatcctggacaccggcgccgccggcagaaacagctacctggaggtgctgctgaagctggccgacaagtacaagaagaagatgtggggctggctgtggaccgaggccggcgcccagagcgagctggagaccgccctgggcatcggcggcttcggctaccccgccatggccgccatcaacgccagaaagatgaagttcgccctgctgaagggcagcttcagcgagcagggcatcaacgagttcctgagagagctgagcttcggcagaggcagcaccgcccccgtgggcggcggcgccttccccaccatcgtggagagagagccctgggacggcagagacggcgagctgcccgtggaggacgacatcgacctgagcgacgtggagctggacgacctgggcaaggacgagctgtag

SEQ ID NO: 95078 - DNA, 1956 bp, Artificial Sequence
  Description of Artificial Sequence: Synthetic coding sequence
atggccgacagcgccgagctgaagcagatggtgatgagcctgagagtgagcgagctgcaggtgctgctgggctacgccggcagaaacaagcacggcagaaagcacgagctgctgaccaaggccctgcacctgctgaaggccggctgcagccccgccgtgcagatgaagatcaaggagctgtacagaagaagattcccccagaagatcatgacccccgccgacctgagcatccccaacgtgcacagcagccccatgcccgccaccctgagccccagcaccatcccccagctgacctacgacggccaccccgccagcagccccctgctgcccgtgagcctgctgggccccaagcacgagctggagctgccccacctgaccagcgccctgcaccccgtgcaccccgacatcaagctgcagaagctgcccttctacgacctgctggacgagctgatcaagcccaccagcctggccagcgacaacagccagagattcagagagacctgcttcgccttcgccctgaccccccagcaggtgcagcagatcagcagcagcatggacatcagcggcaccaagtgcgacttcaccgtgcaggtgcagctgagattctgcctgagcgagaccagctgcccccaggaggaccacttcccccccaacctgtgcgtgaaggtgaacaccaagccctgcagcctgcccggctacctgccccccaccaagaacggcgtggagcccaagagacccagcagacccatcaacatcaccagcctggtgagactgagcaccaccgtgcccaacaccatcgtggtgagctggaccgccgagatcggcagaaactacagcatggccgtgtacctggtgaagcagctgagcagcaccgtgctgctgcagagactgagagccaagggcatcagaaaccccgaccacagcagagccctgatcaaggagaagctgaccgccgaccccgacagcgagatcgccaccaccagcctgagagtgagcctgctgtgccccctgggcaagatgagactgaccatcccctgcagagccctgacctgcagccacctgcagtgcttcgacgccaccctgtacatccagatgaacgagaagaagcccacctgggtgtgccccgtgtgcgacaagaaggccccctacgagcacctgatcatcgacggcctgttcatggagatcctgaagtactgcaccgactgcgacgagatccagttcaaggaggacggcacctgggcccccatgagaagcaagaaggaggtgcaggaggtgagcgccagctacaacggcgtggacggctgcctgagcagcaccctggagcaccaggtggccagccaccaccagagcagcaacaagaacaagaaggtggaggtgatcgacctgaccatcgacagcagcagcgacgaggaggaggaggagcccagcgccaagagaacctgccccagcctgagccccaccagccccctgaacaacaagggcatcctgagcctgccccaccaggccagccccgtgagcagaacccccagcctgcccgccgtggacaccagctacatcaacaccagcctgatccaggactacagacaccccttccacatgacccccatgccctacgacctgcagggcctggacttcttccccttcctgagcggcgacaaccagcactacaacaccagcctgctggccgccgccgccgccgccgtgagcgacgaccaggacctgctgcacagcagcagattcttcccctacaccagcagccagatgttcctggaccagctgagcgccggcggcagcaccagcctgcccaccaccaacggcagcagcagcggcagcaacagcagcctggtgagcagcaacagcctgagagagagccacagccacaccgtgaccaacagaagcagcaccgacaccgccagcatcttcggcatcatccccgacatcatcagcctggactag

SEQ ID NO: 95079 - DNA, 1962 bp, Artificial Sequence
  Description of Artificial Sequence: Synthetic coding sequence
atgttcaccctgcaggacagctacgtgaagcagatggtgatgagcctgagagtgagcgagctgcaggtgctgctgggctacgccggcagaaacaagcacggcagaaagcacgagctgctgaccaaggccctgcacctgctgaaggccggctgcagccccgccgtgcagatgaagatcaaggagctgtacagaagaagattcccccagaagatcatgacccccgccgacctgagcatccccaacgtgcacagcagccccatgcccgccaccctgagccccagcaccatcccccagctgacctacgacggccaccccgccagcagccccctgctgcccgtgagcctgctgggccccaagcacgagctggagctgccccacctgaccagcgccctgcaccccgtgcaccccgacatcaagctgcagaagctgcccttctacgacctgctggacgagctgatcaagcccaccagcctggccagcgacaacagccagagattcagagagacctgcttcgccttcgccctgaccccccagcaggtgcagcagatcagcagcagcatggacatcagcggcaccaagtgcgacttcaccgtgcaggtgcagctgagattctgcctgagcgagaccagctgcccccaggaggaccacttcccccccaacctgtgcgtgaaggtgaacaccaagccctgcagcctgcccggctacctgccccccaccaagaacggcgtggagcccaagagacccagcagacccatcaacatcaccagcctggtgagactgagcaccaccgtgcccaacaccatcgtggtgagctggaccgccgagatcggcagaaactacagcatggccgtgtacctggtgaagcagctgagcagcaccgtgctgctgcagagactgagagccaagggcatcagaaaccccgaccacagcagagccctgatcaaggagaagctgaccgccgaccccgacagcgagatcgccaccaccagcctgagagtgagcctgctgtgccccctgggcaagatgagactgaccatcccctgcagagccctgacctgcagccacctgcagtgcttcgacgccaccctgtacatccagatgaacgagaagaagcccacctgggtgtgccccgtgtgcgacaagaaggccccctacgagcacctgatcatcgacggcctgttcatggagatcctgaagtactgcaccgactgcgacgagatccagttcaaggaggacggcacctgggcccccatgagaagcaagaaggaggtgcaggaggtgagcgccagctacaacggcgtggacggctgcctgagcagcaccctggagcaccaggtggccagccaccaccagagcagcaacaagaacaagaaggtggaggtgatcgacctgaccatcgacagcagcagcgacgaggaggaggaggagcccagcgccaagagaacctgccccagcctgagccccaccagccccctgaacaacaagggcatcctgagcctgccccaccaggccagccccgtgagcagaacccccagcctgcccgccgtggacaccagctacatcaacaccagcctgatccaggactacagacaccccttccacatgacccccatgccctacgacctgcagggcctggacttcttccccttcctgagcggcgacaaccagcactacaacaccagcctgctggccgccgccgccgccgccgtgagcgacgaccaggacctgctgcacagcagcagattcttcccctacaccagcagccagatgttcctggaccagctgagcgccggcggcagcaccagcctgcccaccaccaacggcagcagcagcggcagcaacagcagcctggtgagcagcaacagcctgagagagagccacagccacaccgtgaccaacagaagcagcaccgacaccgccagcatcttcggcatcatccccgacatcatcagcctggactag

SEQ ID NO: 95080 - DNA, 1782 bp, Artificial Sequence
  Description of Artificial Sequence: Synthetic coding sequence
atggccgagctgggcgagctgaagcacatggtgatgagcttcagagtgagcgagctgcaggtgctgctgggcttcgccggcagaaacaagagcggcagaaagcacgagctgctggccaaggccctgcacctgctgaagagcagctgcgcccccagcgtgcagatgaagatcaaggagctgtacagaagaagattccccagaaagaccctgggccccagcgacctgagcctgctgagcctgccccccggcaccagcccccccgtgcaccccgacgtgaccatgaagcccctgcccttctacgaggtgtacggcgagctgatcagacccaccaccctggccagcaccagcagccagagattcgaggaggcccacttcaccttcgccctgaccccccagcaggtgcagcagatcctgaccagcagagaggtgctgcccggcgccaagtgcgactacaccatccaggtgcagctgagattctgcctgtgcgagaccagctgcccccaggaggactacttcccccccaacctgttcgtgaaggtgaacggcaagctgtgccccctgcccggctacctgccccccaccaagaacggcgccgagcccaagagacccagcagacccatcaacatcacccccctggccagactgagcgccaccgtgcccaacaccatcgtggtgaactggagcagcgagttcggcagaaactacagcctgagcgtgtacctggtgagacagctgaccgccggcaccctgctgcagaagctgagagccaagggcatcagaaaccccgaccacagcagagccctgatcaaggagaagctgaccgccgaccccgacagcgaggtggccaccaccagcctgagagtgagcctgatgtgccccctgggcaagatgagactgaccgtgccctgcagagccctgacctgcgcccacctgcagagcttcgacgccgccctgtacctgcagatgaacgagaagaagcccacctggacctgccccgtgtgcgacaagaaggccccctacgagagcctgatcatcgacggcctgttcatggagatcctgagcagctgcagcgactgcgacgagatccagttcatggaggacggcagctggtgccccatgaagcccaagaaggaggccagcgaggtgtgccccccccccggctacggcctggacggcctgcagtacagccccgtgcagggcggcgaccccagcgagaacaagaagaaggtggaggtgatcgacctgaccatcgagagcagcagcgacgaggaggacctgccccccaccaagaagcactgcagcgtgaccagcgccgccatccccgccctgcccggcagcaagggcgtgctgaccagcggccaccagcccagcagcgtgctgagaagccccgccatgggcaccctgggcggcgacttcctgagcagcctgcccctgcacgagtacccccccgccttccccctgggcgccgacatccagggcctggacctgttcagcttcctgcagaccgagagccagcactacggccccagcgtgatcaccagcctggacgagcaggacgccctgggccacttcttccagtacagaggcacccccagccacttcctgggccccctggcccccaccctgggcagcagccactgcagcgccacccccgcccccccccccggcagagtgagcagcatcgtggcccccggcggcgccctgagagagggccacggcggccccctgcccagcggccccagcctgaccggctgcagaagcgacatcatcagcctggactag

SEQ ID NO: 95081 - DNA, 873 bp, Artificial Sequence
  Description of Artificial Sequence: Synthetic coding sequence
atggtgatgagcttcagagtgagcgagctgcaggtgctgctgggcttcgccggcagaaacaagagcggcagaaagcacgagctgctggccaaggccctgcacctgctgaagagcagctgcgcccccagcgtgcagatgaagatcaaggagctgtacagaagaagattccccagaaagaccctgggccccagcgacctgagcctgctgagcctgccccccggcaccagccccgtgggcagccccggccccctggcccccatcccccccaccctgctggcccccggcaccctgctgggccccaagagagaggtggacatgcacccccccctgccccagcccgtgcaccccgacgtgaccatgaagcccctgcccttctacgaggtgtacggcgagctgatcagacccaccaccctggccagcaccagcagccagagattcgaggaggcccacttcaccttcgccctgaccccccagcaggtgcagcagatcctgaccagcagagaggtgctgcccggcgccaagtgcgactacaccatccaggtgcagctgagattctgcctgtgcgagaccagctgcccccaggaggactacttcccccccaacctgttcgtgaaggtgaacggcaagctgtgccccctgcccggctacctgccccccaccaagaacggcgccgagcccaagagacccagcagacccatcaacatcacccccctggccagactgagcgccaccgtgcccaacaccatcgtggtgaactggagcagcgagttcggcagagtgagcaccgccaaggccggcgcctggaagagcctgctgagagtgaagggcaaccaccccgtgagctgggtgggcgaggccttcagcagcctgtag

SEQ ID NO: 95082 - DNA, 1887 bp, Artificial Sequence
  Description of Artificial Sequence: Synthetic coding sequence
atggccgagctgggcgagctgaagcacatggtgatgagcttcagagtgagcgagctgcaggtgctgctgggcttcgccggcagaaacaagagcggcagaaagcacgagctgctggccaaggccctgcacctgctgaagagcagctgcgcccccagcgtgcagatgaagatcaaggagctgtacagaagaagattccccagaaagaccctgggccccagcgacctgagcctgctgagcctgccccccggcaccagccccgtgggcagccccggccccctggcccccatcccccccaccctgctggcccccggcaccctgctgggccccaagagagaggtggacatgcacccccccctgccccagcccgtgcaccccgacgtgaccatgaagcccctgcccttctacgaggtgtacggcgagctgatcagacccaccaccctggccagcaccagcagccagagattcgaggaggcccacttcaccttcgccctgaccccccagcaggtgcagcagatcctgaccagcagagaggtgctgcccggcgccaagtgcgactacaccatccaggtgcagctgagattctgcctgtgcgagaccagctgcccccaggaggactacttcccccccaacctgttcgtgaaggtgaacggcaagctgtgccccctgcccggctacctgccccccaccaagaacggcgccgagcccaagagacccagcagacccatcaacatcacccccctggccagactgagcgccaccgtgcccaacaccatcgtggtgaactggagcagcgagttcggcagaaactacagcctgagcgtgtacctggtgagacagctgaccgccggcaccctgctgcagaagctgagagccaagggcatcagaaaccccgaccacagcagagccctgatcaaggagaagctgaccgccgaccccgacagcgaggtggccaccaccagcctgagagtgagcctgatgtgccccctgggcaagatgagactgaccgtgccctgcagagccctgacctgcgcccacctgcagagcttcgacgccgccctgtacctgcagatgaacgagaagaagcccacctggacctgccccgtgtgcgacaagaaggccccctacgagagcctgatcatcgacggcctgttcatggagatcctgagcagctgcagcgactgcgacgagatccagttcatggaggacggcagctggtgccccatgaagcccaagaaggaggccagcgaggtgtgccccccccccggctacggcctggacggcctgcagtacagccccgtgcagggcggcgaccccagcgagaacaagaagaaggtggaggtgatcgacctgaccatcgagagcagcagcgacgaggaggacctgccccccaccaagaagcactgcagcgtgaccagcgccgccatccccgccctgcccggcagcaagggcgtgctgaccagcggccaccagcccagcagcgtgctgagaagccccgccatgggcaccctgggcggcgacttcctgagcagcctgcccctgcacgagtacccccccgccttccccctgggcgccgacatccagggcctggacctgttcagcttcctgcagaccgagagccagcactacggccccagcgtgatcaccagcctggacgagcaggacgccctgggccacttcttccagtacagaggcacccccagccacttcctgggccccctggcccccaccctgggcagcagccactgcagcgccacccccgcccccccccccggcagagtgagcagcatcgtggcccccggcggcgccctgagagagggccacggcggccccctgcccagcggccccagcctgaccggctgcagaagcgacatcatcagcctggactag

SEQ ID NO: 95083 - DNA, 780 bp, Artificial Sequence
  Description of Artificial Sequence: Synthetic coding sequence
atggtgatgagcttcagagtgagcgagctgcaggtgctgctgggcttcgccggcagaaacaagagcggcagaaagcacgagctgctggccaaggccctgcacctgctgaagagcagctgcgcccccagcgtgcagatgaagatcaaggagctgtacagaagaagattccccagaaagaccctgggccccagcgacctgagcctgctgagcctgccccccggcaccagccccgtgggcagccccggccccctggcccccatcccccccaccctgctggcccccggcaccctgctgggccccaagagagaggtggacatgcacccccccctgccccagcccgtgcaccccgacgtgaccatgaagcccctgcccttctacgaggtgtacggcgagctgatcagacccaccaccctggccagcaccagcagccagagattcgaggaggcccacttcaccttcgccctgaccccccagcaggtgcagcagatcctgaccagcagagaggtgctgcccggcgccaagtgcgactacaccatccaggtgcagctgagattctgcctgtgcgagaccagctgcccccaggaggactacttcccccccaacctgttcgtgaaggtgaacggcaagctgtgccccctgcccggctacctgccccccaccaagaacggcgccgagcccaagagacccagcagacccatcaacatcacccccctggccagactgagcgccaccgtgcccaacaccatcgtggtgaactggagcagcgagttcggcagatag

SEQ ID NO: 95084 - DNA, 1248 bp, Artificial Sequence
  Description of Artificial Sequence: Synthetic coding sequence
atgttcgccgacctggactacgacatcgaggaggacaagctgggcatccccaccgtgcccggcaaggtgaccctgcagaaggacgcccagaacctgatcggcatcagcatcggcggcggcgcccagtactgcccctgcctgtacatcgtgcaggtgttcgacaacacccccgccgccctggacggcaccgtggccgccggcgacgagatcaccggcgtgaacggcagaagcatcaagggcaagaccaaggtggaggtggccaagatgatccaggaggtgaagggcgaggtgaccatccactacaacaagctgcaggccgaccccaagcagggcatgagcctggacatcgtgctgaagaaggtgaagcacagactggtggagaacatgagcagcggcaccgccgacgccctgggcctgagcagagccatcctgtgcaacgacggcctggtgaagagactggaggagctggagagaaccgccgagctgtacaagggcatgaccgagcacaccaagaacctgctgagagccttctacgagctgagccagacccacagagccttcggcgacgtgttcagcgtgatcggcgtgagagagccccagcccgccgccagcgaggccttcgtgaagttcgccgacgcccacagaagcatcgagaagttcggcatcagactgctgaagaccatcaagcccatgctgaccgacctgaacacctacctgaacaaggccatccccgacaccagactgaccatcaagaagtacctggacgtgaagttcgagtacctgagctactgcctgaaggtgaaggagatggacgacgaggagtacagctgcatcgccctgggcgagcccctgtacagagtgagcaccggcaactacgagtacagactgatcctgagatgcagacaggaggccagagccagattcagccagatgagaaaggacgtgctggagaagatggagctgctggaccagaagcacgtgcaggacatcgtgttccagctgcagagactggtgagcaccatgagcaagtactacaacgactgctacgccgtgctgagagacgccgacgtgttccccatcgaggtggacctggcccacaccaccctggcctacggcctgaaccaggaggagttcaccgacggcgaggaggaggaggaggaggaggacaccgccgccggcgagcccagcagagacaccagaggcgccgccggccccctggacaagggcggcagctggtgcgacagctag

SEQ ID NO: 95085 - DNA, 1248 bp, Artificial Sequence; identical to SEQ ID NO: 95084
  Description of Artificial Sequence: Synthetic coding sequence

SEQ ID NO: 95086 - DNA, 690 bp, Artificial Sequence
  Description of Artificial Sequence: Synthetic coding sequence
atgttcgccgacctggactacgacatcgaggaggacaagctgggcatccccaccgtgcccggcaaggtgaccctgcagaaggacgcccagaacctgatcggcatcagcatcggcggcggcgcccagtactgcccctgcctgtacatcgtgcaggtgttcgacaacacccccgccgccctggacggcaccgtggccgccggcgacgagatcaccggcgtgaacggcagaagcatcaagggcaagaccaaggtggaggtggccaagatgatccaggaggtgaagggcgaggtgaccatccactacaacaagctgcaggccgaccccaagcagggcatgagcctggacatcgtgctgaagaaggtgaagcacagactggtggagaacatgagcagcggcaccgccgacgccctgggcctgagcagagccatcctgtgcaacgacggcctggtgaagagactggaggagctggagagaaccgccgagctgtacaagggcatgaccgagcacaccaagaacctgctgagagccttctacgagctgagccagacccacagagccttcggcgacgtgttcagcgtgatcggcgtgagagagccccagcccgccgccagcgaggccttcgtgaagttcgccgacgcccacagaagcatcgagaagttcggcatcagactgctgaagaccatcaagtag

SEQ ID NO: 95087 - DNA, 405 bp, Artificial Sequence
  Description of Artificial Sequence: Synthetic coding sequence
atgttcgccgacctggactacgacatcgaggaggacaagctgggcatccccaccgtgcccggcaaggtgaccctgcagaaggacgcccagaacctgatcggcatcagcatcggcggcggcgcccagtactgcccctgcctgtacatcgtgcaggtgttcgacaacacccccgccgccctggacggcaccgtggccgccggcgacgagatcaccggcgtgaacggcagaagcatcaagggcaagaccaaggtggaggtggccaagatgatccaggaggtgaagggcgaggtgaccatccactacaacaagctgcaggccgaccccaagcagggcatgagcctggacatcgtgctgaagaaggtgaagcacagactggtggagaacatgagcagcggcaccgcctag

SEQ ID NO: 95088 - DNA, 393 bp, Artificial Sequence
  Description of Artificial Sequence: Synthetic coding sequence
atgttcgccgacctggactacgacatcgaggaggacaagctgggcatccccaccgtgcccggcaaggtgaccctgcagaaggacgcccagaacctgatcggcatcagcatcggcggcggcgcccagtactgcccctgcctgtacatcgtgcaggtgttcgacaacacccccgccgccctggacggcaccgtggccgccggcgacgagatcaccggcgtgaacggcagaagcatcaagggcaagaccaaggtggaggtggccaagatgatccaggaggtgaagggcgaggtgaccatccactacaacaagctgcaggccgaccccaagcagggcatgagcctggacatcggccagagactgggcttccacggccccggcccccacagcagctag

SEQ ID NO: 95089 - DNA, 117 bp, Artificial Sequence
  Description of Artificial Sequence: Synthetic coding sequence
atgttcgccgacctggactacgacatcgaggaggacaagctgggcatccccaccgtgcccggcaaggtgaccctgcagaaggacgcccagaacctgatcggcatcagcatcggctag

SEQ ID NO: 95090 - DNA, 231 bp, Artificial Sequence
  Description of Artificial Sequence: Synthetic coding sequence
atgaccgacgtggagaccacctacgccgacttcatcgccagcggcagaaccggcagaagaaacgccatccacgacatcctggtgagcagcgccagcggcaacagcaacgagctggccctgaagctggccggcctggacatcaacaagaccgagggcgaggaggacgcccagagaagcagcaccgagcagagcggcgaggcccagggcgaggccgccaagagcgagagctag

SEQ ID NO: 95091 - DNA, 231 bp, Artificial Sequence; identical to SEQ ID NO: 95090
  Description of Artificial Sequence: Synthetic coding sequence

SEQ ID NO: 95092 - DNA, 231 bp, Artificial Sequence; identical to SEQ ID NO: 95090
  Description of Artificial Sequence: Synthetic coding sequence

SEQ ID NO: 95093 - DNA, 258 bp, Artificial Sequence
  Description of Artificial Sequence: Synthetic coding sequence
atgagccaccaggacgtggccatgagaaccgacagcagcaagatgaccgacgtggagagcggcgtggccaacttcgccagcagcgccagagccggcagaagaaacgccctgcccgacatccagagcagcgccgccaccgacggcaccagcgacctgcccctgaagctggaggccctgagcgtgaaggaggacgccaaggagaaggacgagaagaccacccaggaccagctggagaagccccagaacgaggagaagtag

SEQ ID NO: 95094 - DNA, 237 bp, Artificial Sequence
  Description of Artificial Sequence: Synthetic coding sequence
atgagaaccgacagcagcaagatgaccgacgtggagagcggcgtggccaacttcgccagcagcgccagagccggcagaagaaacgccctgcccgacatccagagcagcgccgccaccgacggcaccagcgacctgcccctgaagctggaggccctgagcgtgaaggaggacgccaaggagaaggacgagaagaccacccaggaccagctggagaagccccagaacgaggagaagtag

SEQ ID NO: 95095 - DNA, 264 bp, Artificial Sequence
  Description of Artificial Sequence: Synthetic coding sequence
atgcacatcctgttcgtggacgtggccatgagaaccgacagcagcaagatgaccgacgtggagagcggcgtggccaacttcgccagcagcgccagagccggcagaagaaacgccctgcccgacatccagagcagcgccgccaccgacggcaccagcgacctgcccctgaagctggaggccctgagcgtgaaggaggacgccaaggagaaggacgagaagaccacccaggaccagctggagaagccccagaacgaggagaagtag

SEQ ID NO: 95096 - DNA, 237 bp, Artificial Sequence; identical to SEQ ID NO: 95094
  Description of Artificial Sequence: Synthetic coding sequence

SEQ ID NO: 95097 - DNA, 237 bp, Artificial Sequence; identical to SEQ ID NO: 95094
  Description of Artificial Sequence: Synthetic coding sequence

SEQ ID NO: 95098 - DNA, 237 bp, Artificial Sequence; identical to SEQ ID NO: 95094
  Description of Artificial Sequence: Synthetic coding sequence

SEQ ID NO: 95099 - DNA, 237 bp, Artificial Sequence; identical to SEQ ID NO: 95094
  Description of Artificial Sequence: Synthetic coding sequence

SEQ ID NO: 95100 - DNA, 231 bp, Artificial Sequence
  Description of Artificial Sequence: Synthetic coding sequence
atgatggaggtggagagcagctacagcgacttcatcagctgcgacagaaccggcagaagaaacgccgtgcccgacatccagggcgacagcgaggccgtgagcgtgagaaagctggccggcgacatgggcgagctggccctggagggcgccgagggccaggtggagggcagcgcccccgacaaggaggccggcaaccagccccagagcagcgacggcaccaccagcagctag

SEQ ID NO: 95101 - DNA, 195 bp, Artificial Sequence
  Description of Artificial Sequence: Synthetic coding sequence
atgatggaggtggagagcagctacagcgacttcatcagctgcgacagaaccggcagaagaaacgccgtgcccgacatccagggcgacagcgaggccgtgagcgtgagaaagctggccggcgacatgggcgagctggccctggagggcgccgagatggacctgaccatgctgccctggctggtgagcaacagctag

SEQ ID NO: 95102 - DNA, 231 bp, Artificial Sequence; identical to SEQ ID NO: 95100
  Description of Artificial Sequence: Synthetic coding sequence

SEQ ID NO: 95103 - DNA, 231 bp, Artificial Sequence; identical to SEQ ID NO: 95100
  Description of Artificial Sequence: Synthetic coding sequence

SEQ ID NO: 95104 - DNA, 231 bp, Artificial Sequence; identical to SEQ ID NO: 95100
  Description of Artificial Sequence: Synthetic coding sequence

SEQ ID NO: 95105 - DNA, 231 bp, Artificial Sequence; identical to SEQ ID NO: 95100
  Description of Artificial Sequence: Synthetic coding sequence

SEQ ID NO: 95106 - DNA, 231 bp, Artificial Sequence; identical to SEQ ID NO: 95100
  Description of Artificial Sequence: Synthetic coding sequence

SEQ ID NO: 95107 - DNA, 1578 bp, Artificial Sequence
  Description of Artificial Sequence: Synthetic coding sequence
atgcccctgctggacggcgacctggagggcagcggcaagcacagcagcagaaaggtggacagccccttcggccccggcagccccagcaagggcttcttcagcagaggcccccagcccagacccagcagccccatgagcgcccccgtgagacccaagaccagccccggcagccccaagaccgtgttccccttcagctaccaggagagcccccccagaagccccagaagaatgagcttcagcggcatcttcagaagcagcagcaaggagagcagccccaacagcaaccccgccaccagccccggcggcatcagattcttcagcagaagcagaaagaccagcggcctgagcagcagccccagcacccccacccaggtgaccaagcagcacaccttccccctggagagctacaagcacgagcccgagagactggagaacagaatctacgccagcagcagcccccccgacaccggccagagattctgccccagcagcttccagagccccaccagaccccccctggccagccccacccactacgcccccagcaaggccgccgccctggccgccgccctgggccccgccgaggccggcatgctggagaagctggagttcgaggacgaggccgtggaggacagcgagagcggcgtgtacatgagattcatgagaagccacaagtgctacgacatcgtgcccaccagcagcaagctggtggtgttcgacaccaccctgcaggtgaagaaggccttcttcgccctggtggccaacggcgtgagagccgcccccctgtgggagagcaagaagcagagcttcgtgggcatgctgaccatcaccgacttcatcaacatcctgcacagatactacaagagccccatggtgcagatctacgagctggaggagcacaagatcgagacctggagagagctgtacctgcaggagaccttcaagcccctggtgaacatcagccccgacgccagcctgttcgacgccgtgtacagcctgatcaagaacaagatccacagactgcccgtgatcgaccccatcagcggcaacgccctgtacatcctgacccacaagagaatcctgaagttcctgcagctgttcatgagcgacatgcccaagcccgccttcatgaagcagaacctggacgagctgggcatcggcacctaccacaacatcgccttcatccaccccgacacccccatcatcaaggccctgaacatcttcgtggagagaagaatcagcgccctgcccgtggtggacgagagcggcaaggtggtggacatctacagcaagttcgacgtgatcaacctggccgccgagaagacctacaacaacctggacatcaccgtgacccaggccctgcagcacagaagccagtacttcgagggcgtggtgaagtgcaacaagctggagatcctggagaccatcgtggacagaatcgtgagagccgaggtgcacagactggtggtggtgaacgaggccgacagcatcgtgggcatcatcagcctgagcgacatcctgcaggccctgatcctgacccccgccggcgccaagcagaaggagaccgagaccgagtag

SEQ ID NO: 95108 - DNA, 987 bp, Artificial Sequence
  Description of Artificial Sequence: Synthetic coding sequence
atgctggagaagctggagttcgaggacgaggccgtggaggacagcgagagcggcgtgtacatgagattcatgagaagccacaagtgctacgacatcgtgcccaccagcagcaagctggtggtgttcgacaccaccctgcaggtgaagaaggccttcttcgccctggtggccaacggcgtgagagccgcccccctgtgggagagcaagaagcagagcttcgtgggcatgctgaccatcaccgacttcatcaacatcctgcacagatactacaagagccccatggtgcagatctacgagctggaggagcacaagatcgagacctggagagagctgtacctgcaggagaccttcaagcccctggtgaacatcagccccgacgccagcctgttcgacgccgtgtacagcctgatcaagaacaagatccacagactgcccgtgatcgaccccatcagcggcaacgccctgtacatcctgacccacaagagaatcctgaagttcctgcagctgttcatgagcgacatgcccaagcccgccttcatgaagcagaacctggacgagctgggcatcggcacctaccacaacatcgccttcatccaccccgacacccccatcatcaaggccctgaacatcttcgtggagagaagaatcagcgccctgcccgtggtggacgagagcggcaaggtggtggacatctacagcaagttcgacgtgatcaacctggccgccgagaagacctacaacaacctggacatcaccgtgacccaggccctgcagcacagaagccagtacttcgagggcgtggtgaagtgcaacaagctggagatcctggagaccatcgtggacagaatcgtgagagccgaggtgcacagactggtggtggtgaacgaggccgacagcatcgtgggcatcatcagcctgagcgacatcctgcaggccctgatcctgacccccgccggcgccaagcagaaggagaccgagaccgagtag

SEQ ID NO: 95109 - DNA, 1335 bp, Artificial Sequence
  Description of Artificial Sequence: Synthetic coding sequence
atgagcagcagctacgacgaggccagcctggcccccgaggagaccaccgacagcttctgggaggtgggcaactacaagagaaccgtgaagagaatcgacgacggccacagactgtgcaacgacctgatgaactgcgtgcaggagagagccaagatcgagaaggcctacggccagcagctgaccgactgggccaagagatggagacagctgatcgagaagggcccccagtacggcagcctggagagagcctggggcgccatcatgaccgaggccgacaaggtgagcgagctgcaccaggaggtgaagaacaacctgctgaacgaggacctggagaaggtgaagaactggcagaaggacgcctaccacaagcagatcatgggcggcttcaaggagaccaaggaggccgaggacggcttcagaaaggcccagaagccctgggccaagaagatgaaggagctggaggccgccaagaaggcctaccacctggcctgcaaggaggagaagctggccatgaccagagagatgaacagcaagaccgagcagagcgtgacccccgagcagcagaagaagctgcaggacaaggtggacaagtgcaagcaggacgtgcagaagacccaggagaagtacgagaaggtgctggaggacgtgggcaagaccaccccccagtacatggagaacatggagcaggtgttcgagcagtgccagcagttcgaggagaagagactggtgttcctgaaggaggtgctgctggacatcaagagacacctgaacctggccgagaacagcagctacatccacgtgtacagagagctggagcaggccatcagaggcgccgacgcccaggaggacctgagatggttcagaagcaccagcggccccggcatgcccatgaactggccccagttcgaggagtggaaccccgacctgccccacaccaccaccaagaaggagaagcagcccaagaaggccgagggcgtggccctgaccaacgccaccggcgccgtggagagcaccagccaggccggcgacagaggcagcgtgagcagctacgacagaggccagccctacgccaccgagtggagcgacgacgagagcggcaaccccttcggcggcagcgagaccaacggcggcgccaaccccttcgaggacgacagcaagggcgtgagagtgagagccctgtacgactacgacggccaggagcaggacgagctgagcttcaaggccggcgacgagctgaccaagctgggcgaggaggacgagcagggctggtgcagaggcagactggacagcggccagctgggcctgtaccccgccaactacgtggaggccatctag

SEQ ID NO: 95110 - DNA, 1281 bp, Artificial Sequence
  Description of Artificial Sequence: Synthetic coding sequence
atgagcagcagctacgacgaggccagcctggcccccgaggagaccaccgacagcttctgggaggtgggcaactacaagagaaccgtgaagagaatcgacgacggccacagactgtgcaacgacctgatgaactgcgtgcaggagagagccaagatcgagaaggcctacggccagcagctgaccgactgggccaagagatggagacagctgatcgagaagggcccccagtacggcagcctggagagagcctggggcgccatcatgaccgaggccgacaaggtgagcgagctgcaccaggaggtgaagaacaacctgctgaacgaggacctggagaaggtgaagaactggcagaaggacgcctaccacaagcagatcatgggcggcttcaaggagaccaaggaggccgaggacggcttcagaaaggcccagaagccctgggccaagaagatgaaggagctggaggccgccaagaaggcctaccacctggcctgcaaggaggagaagctggccatgaccagagagatgaacagcaagaccgagcagagcgtgacccccgagcagcagaagaagctgcaggacaaggtggacaagtgcaagcaggacgtgcagaagacccaggagaagtacgagaaggtgctggaggacgtgggcaagaccaccccccagtacatggagaacatggagcaggtgttcgagcagtgccagcagttcgaggagaagagactggtgttcctgaaggaggtgctgctggacatcaagagacacctgaacctggccgagaacagcagctacatccacgtgtacagagagctggagcaggccatcagaggcgccgacgcccaggaggacctgagatggttcagaagcaccagcggccccggcatgcccatgaactggccccagttcgaggagtggaaccccgacctgccccacaccaccaccaagaaggagaagcagcccaagaaggccgagggcgtggccctgaccaacgccaccggcgccgtggagagcaccagccaggccggcgacagaggcagcgtgagcagctacgacagaggccagccctacgccaccgagtggagcgacgacgagagcggcaaccccttcggcggcagcgagaccaacggcggcgccaaccccttcgaggacgacagcaagggcgtgagagtgagagccctgtacgactacgacggccaggagcaggacgagctgagcttcaaggccggcgacgagctgaccaagctgggcctgtaccccgccaactacgtggaggccatctag

SEQ ID NO: 95111 - DNA, 1335 bp, Artificial Sequence; identical to SEQ ID NO: 95109
  Description of Artificial Sequence: Synthetic coding sequence

SEQ ID NO: 95112 - DNA, 1275 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagaagggcccccagtacggcaccctggagaaggcctggcacgccttcttcaccgccgccgagagactgagcgccctgcacctggaggtgagagagaagctgcagggccaggacagcgagagagtgagagcctggcagagaggcgccttccacagacccgtgctgggcggcttcagagagagcagagccgccgaggacggcttcagaaaggcccagaagccctggctgaagagactgaaggaggtggaggccagcaagaagagctaccacgccgccagaaaggacgagaagaccgcccagaccagagagagccacgccaaggccgacagcgccgtgagccaggagcagctgagaaagctgcaggagagagtggagagatgcgccaaggaggccgagaagaccaaggcccagtacgagcagaccctggccgagctgcacagatacacccccagatacatggaggacatggagcaggccttcgagacctgccaggccgccgagagacagagactgctgttcttcaaggacatgctgctgaccctgcaccagcacctggacctgagcagcagcgagaagttccacgagctgcacagagacctgcaccagggcatcgaggccgccagcgacgaggaggacctgagatggtggagaagcacccacggccccggcatggccatgaactggccccagttcgaggagtggagcctggacacccagagaaccatcagcagaaaggagaagggcggcagaagccccgacgaggtgaccctgaccagcatcgtgcccaccagagacggcaccgccccccccccccagagccccggcagccccggcaccggccaggacgaggagtggagcgacgaggagagccccagaaaggccgccaccggcgtgagagtgagagccctgtacgactacgccggccaggaggccgacgagctgagcttcagagccggcgaggagctgctgaagatgagcgaggaggacgagcagggctggtgccagggccagctgcagagcggcagaatcggcctgtaccccgccaactacgtggagtgcgtgggcgcctag

SEQ ID NO: 95113 - DNA, 879 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagaagggcccccagtacggcaccctggagaaggcctggcacgccttcttcaccgccgccgagagactgagcgccctgcacctggaggtgagagagaagctgcagggccaggacagcgagagagtgagagcctggcagagaggcgccttccacagacccgtgctgggcggcttcagagagagcagagccgccgaggacggcttcagaaaggcccagaagccctggctgaagagactgaaggaggtggaggccagcaagaagagctaccacgccgccagaaaggacgagaagaccgcccagaccagagagacccagagacagaccgcccccagccccagaagcagctgcgccaactgcagaaacggctggaacgccgtgcccagaagacccagaagacagaagctgagcatgagcagaagatggcagagctgcatcgccaccctgcacgccacctggagaacctggaacagacccctgagacccgccagaccccccagcgccagcggcttcttcagcagcagaatctgctgcagcccctacaccagcacctggaccttccccgccgtgagaagcagcatgaacagcaccgtgacctgcaccagagccctgagacagcccgtgaccaagagaatctgcgccggcggcgccgcccccaccggccaggcctggccctag

SEQ ID NO: 95114 - DNA, 210 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagtag

SEQ ID NO: 95115 - DNA, 429 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagaagggcccccagtacggcaccctggagaaggcctggcacgccttcttcaccgccgccgagagactgagcgccctgcacctggaggtgagagagaagctgcagggccaggacagcgagagagtgagagcctggcagagaggcgccttccacagacccgtgctgggcggcttcagagagagcagagccgccgaggacggcttcagaaaggcccagaagccctag

SEQ ID NO: 95116 - DNA, 1218 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagaagggcccccagtacggcaccctggagaaggcctggcacgccttcttcaccgccgccgagagactgagcgccctgcacctggaggtgagagagaagctgcagggccaggacagcgagagagtgagagcctggcagagaggcgccttccacagacccgtgctgggcggcttcagagagagcagagccgccgaggacggcttcagaaaggcccagaagccctggctgaagagactgaaggaggtggaggccagcaagaagagctaccacgccgccagaaaggacgagaagaccgcccagaccagagagagccacgccaaggccgacagcgccgtgagccaggagcagctgagaaagctgcaggagagagtggagagatgcgccaaggaggccgagaagaccaaggcccagtacgagcagaccctggccgagctgcacagatacacccccagatacatggaggacatggagcaggccttcgagacctgccaggccgccgagagacagagactgctgttcttcaaggacatgctgctgaccctgcaccagcacctggacctgagcagcagcgagaagttccacgagctgcacagagacctgcaccagggcatcgaggccgccagcgacgaggaggacctgagatggtggagaagcacccacggccccggcatggccatgaactggccccagttcgaggagtggagcctggacacccagagaaccatcagcagaaaggagaagggcggcagaagccccgacgaggtgaccctgaccagcatcgtgcccaccagagacggcaccgccccccccccccagagccccggcagccccggcaccggccaggacgaggagtggagcgacgaggagagccccagaaaggccgccaccggcgtgagagtgagagccctgtacgactacgccggccaggaggccgacgagctgagcttcagagccggcgaggagctgctgaagatgagcgaggaggacgagcagggctggtgccagggccagtag

SEQ ID NO: 95117 - DNA, 210 bp, Artificial Sequence; identical to SEQ ID NO: 95114
  Description of Artificial Sequence: Synthetic coding sequence

SEQ ID NO: 95118 - DNA, 447 bp, Artificial Sequence
  Description of Artificial Sequence: Synthetic coding sequence
atggcccccgaggaggacgccggcggcgaggccctgggcggcagcttctgggaggccggcaactacagaagaaccgtgcagagagtggaggacggccacagactgtgcggcgacctggtgagctgcttccaggagagagccagaatcgagaaggcctacgcccagcagctggccgactgggccagaaagtggagaggcaccgtggagaagggcccccagtacggcaccctggagaaggcctggcacgccttcttcaccgccgccgagagactgagcgccctgcacctggaggtgagagagaagctgcagggccaggacagcgagagagtgagagcctggcagagaggcgccttccacagacccgtgctgggcggcttcagagagagcagagccgccgaggacggcttcagaaaggcccagaagccctggctgaagagactgaagtag

SEQ ID NO: 95119 - DNA, 1275 bp, Artificial Sequence; identical to SEQ ID NO: 95112
  Description of Artificial Sequence: Synthetic coding sequence

SEQ ID NO: 95120 - DNA, 1587 bp, Artificial Sequence
  Description of Artificial Sequence: Synthetic coding sequence
atgctgctgcccctgctgctgctgctgcccatgtgctgggccgtggaggtgaagagacccagaggcgtgagcctgaccaaccaccacttctacgacgagagcaagcccttcacctgcctggacggcagcgccaccatccccttcgaccaggtgaacgacgactactgcgactgcaaggacggcagcgacgagcccggcaccgccgcctgccccaacggcagcttccactgcaccaacaccggctacaagcccctgtacatccccagcaacagagtgaacgacggcgtgtgcgactgctgcgacggcaccgacgagtacaacagcggcgtgatctgcgagaacacctgcaaggagaagggcagaaaggagagagagagcctgcagcagatggccgaggtgaccagagagggcttcagactgaagaagatcctgatcgaggactggaagaaggccagagaggagaagcagaagaagctgatcgagctgcaggccggcaagaagagcctggaggaccaggtggagatgctgagaaccgtgaaggaggaggccgagaagcccgagagagaggccaaggagcagcaccagaagctgtgggaggagcagctggccgccgccaaggcccagcaggagcaggagctggccgccgacgccttcaaggagctggacgacgacatggacggcaccgtgagcgtgaccgagctgcagacccaccccgagctggacaccgacggcgacggcgccctgagcgaggccgaggcccaggccctgctgagcggcgacacccagaccgacgccaccagcttctacgacagagtgtgggccgccatcagagacaagtacagaagcgaggccctgcccaccgacctgcccgcccccagcgcccccgacctgaccgagcccaaggaggagcagccccccgtgcccagcagccccaccgaggaggaggaggaggaggaggaggaggaggaggaggaggccgaggaggaggaggaggaggaggacagcgaggaggcccccccccccctgagccccccccagcccgccagccccgccgaggaggacaagatgcccccctacgacgagcagacccaggccttcatcgacgccgcccaggaggccagaaacaagttcgaggaggccgagagaagcctgaaggacatggaggagagcatcagaaacctggagcaggagatcagcttcgacttcggccccaacggcgagttcgcctacctgtacagccagtgctacgagctgaccaccaacgagtacgtgtacagactgtgccccttcaagctggtgagccagaagcccaagctgggcggcagccccaccagcctgggcacctggggcagctggatcggccccgaccacgacaagttcagcgccatgaagtacgagcagggcaccggctgctggcagggccccaacagaagcaccaccgtgagactgctgtgcggcaaggagaccatggtgaccagcaccaccgagcccagcagatgcgagtacctgatggagctgatgacccccgccgcctgccccgagcccccccccgaggcccccaccgaggacgaccacgacgagctgtag

SEQ ID NO: 95121 - DNA, 1578 bp, Artificial Sequence
  Description of Artificial Sequence: Synthetic coding sequence
atgctgctgcccctgctgctgctgctgcccatgtgctgggccgtggaggtgaagagacccagaggcgtgagcctgaccaaccaccacttctacgacgagagcaagcccttcacctgcctggacggcagcgccaccatccccttcgaccaggtgaacgacgactactgcgactgcaaggacggcagcgacgagcccggcaccgccgcctgccccaacggcagcttccactgcaccaacaccggctacaagcccctgtacatccccagcaacagagtgaacgacggcgtgtgcgactgctgcgacggcaccgacgagtacaacagcggcgtgatctgcgagaacacctgcaaggagaagggcagaaaggagagagagagcctgcagcagatggccgaggtgaccagagagggcttcagactgaagaagatcctgatcgaggactggaagaaggccagagaggagaagcagaagaagctgatcgagctgcaggccggcaagaagagcctggaggaccaggtggagatgctgagaaccgtgaaggaggaggccgagaagcccgagagagaggccaaggagcagcaccagaagctgtgggaggagcagctggccgccgccaaggcccagcaggagcaggagctggccgccgacgccttcaaggagctggacgacgacatggacggcaccgtgagcgtgaccgagctgcagacccaccccgagctggacaccgacggcgacggcgccctgagcgaggccgaggcccaggccctgctgagcggcgacacccagaccgacgccaccagcttctacgacagagtgtgggccgccatcagagacaagtacagaagcgaggccctgcccaccgacctgcccgcccccagcgcccccgacctgaccgagcccaaggaggagcagccccccgtgcccagcagccccaccgaggaggaggaggaggaggaggaggaggaggaggaggaggccgaggaggaggaggaggaggaggacagcgaggtgcagggcgagcagcccaagcccgccagccccgccgaggaggacaagatgcccccctacgacgagcagacccaggccttcatcgacgccgcccaggaggccagaaacaagttcgaggaggccgagagaagcctgaaggacatggaggagagcatcagaaacctggagcaggagatcagcttcgacttcggccccaacggcgagttcgcctacctgtacagccagtgctacgagctgaccaccaacgagtacgtgtacagactgtgccccttcaagctggtgagccagaagcccaagctgggcggcagccccaccagcctgggcacctggggcagctggatcggccccgaccacgacaagttcagcgccatgaagtacgagcagggcaccggctgctggcagggccccaacagaagcaccaccgtgagactgctgtgcggcaaggagaccatggtgaccagcaccaccgagcccagcagatgcgagtacctgatggagctgatgacccccgccgcctgccccgagcccccccccgaggcccccaccgaggacgaccacgacgagctgtag

SEQ ID NO: 95122 - DNA, 2031 bp, Artificial Sequence
  Description of Artificial Sequence: Synthetic coding sequence
atggcccccttcctgagaatcgccttcaacagctacgagctgggcagcctgcaggccgaggacgaggccaaccagcccttctgcgccgtgaagatgaaggaggccctgagcaccgagagaggcaagaccctggtgcagaagaagcccaccatgtaccccgagtggaagagcaccttcgacgcccacatctacgagggcagagtgatccagatcgtgctgatgagagccgccgaggagcccgtgagcgaggtgaccgtgggcgtgagcgtgctggccgagagatgcaagaagaacaacggcaaggccgagttctggctggacctgcagccccaggccaaggtgctgatgagcgtgcagtacttcctggaggacgtggactgcaagcagagcatgagaagcgaggacgaggccaagttccccaccatgaacagaagaggcgccatcaagcaggccaagatccactacatcaagaaccacgagttcatcgccaccttcttcggccagcccaccttctgcagcgtgtgcaaggacttcgtgtggggcctgaacaagcagggctacaagtgcagacagtgcaacgccgccatccacaagaagtgcatcgacaagatcatcggcagatgcaccggcaccgccgccaacagcagagacaccatcttccagaaggagagattcaacatcgacatgccccacagattcaaggtgcacaactacatgagccccaccttctgcgaccactgcggcagcctgctgtggggcctggtgaagcagggcctgaagtgcgaggactgcggcatgaacgtgcaccacaagtgcagagagaaggtggccaacctgtgcggcatcaaccagaagctgctggccgaggccctgaaccaggtgacccagagagccagcagaagaagcgacagcgccagcagcgagcccgtgggcatctaccagggcttcgagaagaagaccggcgtggccggcgaggacatgcaggacaacagcggcacctacggcaagatctgggagggcagcagcaagtgcaacatcaacaacttcatcttccacaaggtgctgggcaagggcagcttcggcaaggtgctgctgggcgagctgaagggcagaggcgagtacttcgccatcaaggccctgaagaaggacgtggtgctgatcgacgacgacgtggagtgcaccatggtggagaagagagtgctgaccctggccgccgagaaccccttcctgacccacctgatctgcaccttccagaccaaggaccacctgttcttcgtgatggagttcctgaacggcggcgacctgatgtaccacatccaggacaagggcagattcgagctgtacagagccaccttctacgccgccgagatcatgtgcggcctgcagttcctgcacagcaagggcatcatctacagagacctgaagctggacaacgtgctgctggacagagacggccacatcaagatcgccgacttcggcatgtgcaaggagaacatcttcggcgagagcagagccagcaccttctgcggcacccccgactacatcgcccccgagatcctgcagggcctgaagtacaccttcagcgtggactggtggagcttcggcgtgctgctgtacgagatgctgatcggccagagccccttccacggcgacgacgaggacgagctgttcgagagcatcagagtggacaccccccactaccccagatggatcaccaaggagagcaaggacatcctggagaagctgttcgagagagagcccaccaagagactgggcgtgaccggcaacatcaagatccaccccttcttcaagaccatcaactggaccctgctggagaagagaagactggagccccccttcagacccaaggtgaagagccccagagactacagcaacttcgaccaggagttcctgaacgagaaggccagactgagctacagcgacaagaacctgatcgacagcatggaccagagcgccttcgccggcttcagcttcgtgaaccccaagttcgagcacctgctggaggactag

SEQ ID NO: 95123 - DNA, 2031 bp, Artificial Sequence; identical to SEQ ID NO: 95122
  Description of Artificial Sequence: Synthetic coding sequence

SEQ ID NO: 95124 - DNA, 234 bp, Artificial Sequence
  Description of Artificial Sequence: Synthetic coding sequence
atggcccccttcctgagaatcgccttcaacagctacgagctgggcagcctgcaggccgaggacgaggccaaccagcccttctgcgccgtgaagatgaaggaggccctgagcaccgagagaggcaagaccctggtgcagaagaagcccaccatgtaccccgagtggaagagcaccttcgacgcccacatctacgagggcagagtgatccagatcgtgctgatgagagccgcctag

SEQ ID NO: 95125 - DNA, 378 bp, Artificial Sequence
  Description of Artificial Sequence: Synthetic coding sequence
atggcccccttcctgagaatcgccttcaacagctacgagctgggcagcctgcaggccgaggacgaggccaaccagcccttctgcgccgtgaagatgaaggaggccctgagcaccgagagaggcaagaccctggtgcagaagaagcccaccatgtaccccgagtggaagagcaccttcgacgcccacatctacgagggcagagtgatccagatcgtgctgatgagagccgccgaggagcccgtgagcgaggtgaccgtgggcgtgagcgtgctggccgagagatgcaagaagaacaacggcaaggccgagttctggctggacctgcagccccaggccaaggtgctgatgagcgtgcagtacttcctggaggacgtgtag

SEQ ID NO: 95126 - DNA, 2052 bp, Artificial Sequence
  Description of Artificial Sequence: Synthetic coding sequence
atgagcagcggcaccatgaagttcaacggctacctgagagtgagaatcggcgaggccgtgggcctgcagcccaccagatggagcctgagacacagcctgttcaagaagggccaccagctgctggacccctacctgaccgtgagcgtggaccaggtgagagtgggccagaccagcaccaagcagaagaccaacaagcccacctacaacgaggagttctgcgccaacgtgaccgacggcggccacctggagctggccgtgttccacgagacccccctgggctacgaccacttcgtggccaactgcaccctgcagttccaggagctgctgagaaccaccggcgccagcgacaccttcgagggctgggtggacctggagcccgagggcaaggtgttcgtggtgatcaccctgaccggcagcttcaccgaggccaccctgcagagagacagaatcttcaagcacttcaccagaaagagacagagagccatgagaagaagagtgcaccagatcaacggccacaagttcatggccacctacctgagacagcccacctactgcagccactgcagagagttcatctggggcgtgttcggcaagcagggctaccagtgccaggtgtgcacctgcgtggtgcacaagagatgccaccacctgatcgtgaccgcctgcacctgccagaacaacatcaacaaggtggacagcaagatcgccgagcagagattcggcatcaacatcccccacaagttcagcatccacaactacaaggtgcccaccttctgcgaccactgcggcagcctgctgtggggcatcatgagacagggcctgcagtgcaagatctgcaagatgaacgtgcacatcagatgccaggccaacgtggcccccaactgcggcgtgaacgccgtggagctggccaagaccctggccggcatgggcctgcagcccggcaacatcagccccaccagcaagctggtgagcagaagcaccctgagaagacagggcaaggagagcagcaaggagggcaacggcatcggcgtgaacagcagcaacagactgggcatcgacaacttcgagttcatcagagtgctgggcaagggcagcttcggcaaggtgatgctggccagagtgaaggagaccggcgacctgtacgccgtgaaggtgctgaagaaggacgtgatcctgcaggacgacgacgtggagtgcaccatgaccgagaagagaatcctgagcctggccagaaaccaccccttcctgacccagctgttctgctgcttccagacccccgacagactgttcttcgtgatggagttcgtgaacggcggcgacctgatgttccacatccagaagagcagaagattcgacgaggccagagccagattctacgccgccgagatcatcagcgccctgatgttcctgcacgacaagggcatcatctacagagacctgaagctggacaacgtgctgctggaccacgagggccactgcaagctggccgacttcggcatgtgcaaggagggcatctgcaacggcgtgaccaccgccaccttctgcggcacccccgactacatcgcccccgagatcctgcaggagatgctgtacggccccgccgtggactggtgggccatgggcgtgctgctgtacgagatgctgtgcggccacgcccccttcgaggccgagaacgaggacgacctgttcgaggccatcctgaacgacgaggtggtgtaccccacctggctgcacgaggacgccaccggcatcctgaagagcttcatgaccaagaaccccaccatgagactgggcagcctgacccagggcggcgagcacgccatcctgagacaccccttcttcaaggagatcgactgggcccagctgaaccacagacagatcgagccccccttcagacccagaatcaagagcagagaggacgtgagcaacttcgaccccgacttcatcaaggaggagcccgtgctgacccccatcgacgagggccacctgcccatgatcaaccaggacgagttcagaaacttcagctacgtgagccccgagctgcagccctag

SEQ ID NO: 95127 - DNA, 357 bp, Artificial Sequence
  Description of Artificial Sequence: Synthetic coding sequence
atgagcagcggcaccatgaagttcaacggctacctgagagtgagaatcggcgaggccgtgggcctgcagcccaccagatggagcctgagacacagcctgttcaagaagggccaccagctgctggacccctacctgaccgtgagcgtggaccaggtgagagtgggccagaccagcaccaagcagaagaccaacaagcccacctacaacgaggagttctgcgccaacgtgaccgacggcggccacctggagctggccgtgttccacgagacccccctgggctacgaccacttcgtggccaactgcaccctgcagttccaggagctgctgagaaccaccggcgccagcgacaccttctag

SEQ ID NO: 95128 - DNA, 1791 bp, Artificial Sequence
  Description of Artificial Sequence: Synthetic coding sequence
atgcccacccagagagacagcagcaccatgagccacaccgtggccggcggcggcagcggcgaccacagccaccaggtgagagtgaaggcctactacagaggcgacatcatgatcacccacttcgagcccagcatcagcttcgagggcctgtgcaacgaggtgagagacatgtgcagcttcgacaacgagcagctgttcaccatgaagtggatcgacgaggagggcgacccctgcaccgtgagcagccagctggagctggaggaggccttcagactgtacgagctgaacaaggacagcgagctgctgatccacgtgttcccctgcgtgcccgagagacccggcatgccctgccccggcgaggacaagagcatctacagaagaggcgccagaagatggagaaagctgtactgcgccaacggccacaccttccaggccaagagattcaacagaagagcccactgcgccatctgcaccgacagaatctggggcctgggcagacagggctacaagtgcatcaactgcaagctgctggtgcacaagaagtgccacaagctggtgaccatcgagtgcggcagacacagcctgccccaggagcccgtgatgcccatggaccagagcagcatgcacagcgaccacgcccagaccgtgatcccctacaaccccagcagccacgagagcctggaccaggtgggcgaggagaaggaggccatgaacaccagagagagcggcaaggccagcagcagcctgggcctgcaggacttcgacctgctgagagtgatcggcagaggcagctacgccaaggtgctgctggtgagactgaagaagaccgacagaatctacgccatgaaggtggtgaagaaggagctggtgaacgacgacgaggacatcgactgggtgcagaccgagaagcacgtgttcgagcaggccagcaaccaccccttcctggtgggcctgcacagctgcttccagaccgagagcagactgttcttcgtgatcgagtacgtgaacggcggcgacctgatgttccacatgcagagacagagaaagctgcccgaggagcacgccagattctacagcgccgagatcagcctggccctgaactacctgcacgagagaggcatcatctacagagacctgaagctggacaacgtgctgctggacagcgagggccacatcaagctgaccgactacggcatgtgcaaggagggcctgagacccggcgacaccaccagcaccttctgcggcacccccaactacatcgcccccgagatcctgagaggcgaggactacggcttcagcgtggactggtgggccctgggcgtgctgatgttcgagatgatggccggcagaagccccttcgacatcgtgggcagcagcgacaaccccgaccagaacaccgaggactacctgttccaggtgatcctggagaagcagatcagaatccccagaagcctgagcgtgaaggccgccagcgtgctgaagagcttcctgaacaaggaccccaaggagagactgggctgccacccccagaccggcttcgccgacatccagggccaccccttcttcagaaacgtggactgggacatgatggagcagaagcaggtggtgccccccttcaagcccaacatcagcggcgagttcggcctggacaacttcgacagccagttcaccaacgagcccgtgcagctgacccccgacgacgacgacatcgtgagaaagatcgaccagagcgagttcgagggcttcgagtacatcaaccccctgctgatgagcgccgaggagtgcgtgtag

SEQ ID NO: 95129 - DNA, 2121 bp, Artificial Sequence
  Description of Artificial Sequence: Synthetic coding sequence
atgagccccttcctgagaatcggcctgagcaacttcgactgcggcagctgccagagctgccagggcgaggccgtgaacccctactgcgccgtgctggtgaaggagtacgtggagagcgagaacggccagatgtacatccagaagaagcccaccatgtaccccccctgggacagcaccttcgacgcccacatcaacaagggcagagtgatgcagatcatcgtgaagggcaagaacgtggacctgatcagcgagaccaccgtggagctgtacagcctggccgagagatgcagaaagaacaacggcaagaccgagatctggctggagctgaagccccagggcagaatgctgatgaacgccagatacttcctggagatgagcgacaccaaggacatgaacgagttcgagaccgagggcttcttcgccctgcaccagagaagaggcgccatcaagcaggccaaggtgcaccacgtgaagtgccacgagttcaccgccaccttcttcccccagcccaccttctgcagcgtgtgccacgagttcgtgtggggcctgaacaagcagggctaccagtgcagacagtgcaacgccgccatccacaagaagtgcatcgacaaggtgatcgccaagtgcaccggcagcgccatcaacagcagagagaccatgttccacaaggagagattcaagatcgacatgccccacagattcaaggtgtacaactacaagagccccaccttctgcgagcactgcggcaccctgctgtggggcctggccagacagggcctgaagtgcgacgcctgcggcatgaacgtgcaccacagatgccagaccaaggtggccaacctgtgcggcatcaaccagaagctgatggccgaggccctggccatgatcgagagcacccagcaggccagatgcctgagagacaccgagcagatcttcagagagggccccgtggagatcggcctgccctgcagcatcaagaacgaggccagacccccctgcctgcccacccccggcaagagagagccccagggcatcagctgggagagccccctggacgaggtggacaagatgtgccacctgcccgagcccgagctgaacaaggagagacccagcctgcagatcaagctgaagatcgaggacttcatcctgcacaagatgctgggcaagggcagcttcggcaaggtgttcctggccgagttcaagaagaccaaccagttcttcgccatcaaggccctgaagaaggacgtggtgctgatggacgacgacgtggagtgcaccatggtggagaagagagtgctgagcctggcctgggagcaccccttcctgacccacatgttctgcaccttccagaccaaggagaacctgttcttcgtgatggagtacctgaacggcggcgacctgatgtaccacatccagagctgccacaagttcgacctgagcagagccaccttctacgccgccgagatcatcctgggcctgcagttcctgcacagcaagggcatcgtgtacagagacctgaagctggacaacatcctgctggacaaggacggccacatcaagatcgccgacttcggcatgtgcaaggagaacatgctgggcgacgccaagaccaacaccttctgcggcacccccgactacatcgcccccgagatcctgctgggccagaagtacaaccacagcgtggactggtggagcttcggcgtgctgctgtacgagatgctgatcggccagagccccttccacggccaggacgaggaggagctgttccacagcatcagaatggacaaccccttctaccccagatggctggagaaggaggccaaggacctgctggtgaagctgttcgtgagagagcccgagaagagactgggcgtgagaggcgacatcagacagcaccccctgttcagagagatcaactgggaggagctggagagaaaggagatcgacccccccttcagacccaaggtgaagagccccttcgactgcagcaacttcgacaaggagttcctgaacgagaagcccagactgagcttcgccgacagagccctgatcaacagcatggaccagaacatgttcagaaacttcagcttcatgaaccccggcatggagagactgatcagctag

SEQ ID NO: 95130 - DNA, 1932 bp, Artificial Sequence
  Description of Artificial Sequence: Synthetic coding sequence
atgagccccttcctgagaatcggcctgagcaacttcgactgcggcagctgccagagctgccagggcgaggccgtgaacccctactgcgccgtgctggtgaaggagtacgtggagagcgagaacggccagatgtacatccagaagaagcccaccatgtaccccccctgggacagcaccttcgacgcccacatcaacaagggcagagtgatgcagatcatcgtgaagggcaagaacgtggacctgatcagcgagaccaccgtggagctgtacagcctggccgagagatgcagaaagaacaacggcaagaccgagatctggctggagctgaagccccagggcagaatgctgatgaacgccagatacttcctggagatgagcgacaccaaggacatgaacgagttcgagaccgagggcttcttcgccctgcaccagagaagaggcgccatcaagcaggccaaggtgcaccacgtgaagtgccacgagttcaccgccaccttcttcccccagcccaccttctgcagcgtgtgccacgagttcgtgtggggcctgaacaagcagggctaccagtgcagacagtgcaacgccgccatccacaagaagtgcatcgacaaggtgatcgccaagtgcaccggcagcgccatcaacagcagagagaccatgttccacaaggagagattcaagatcgacatgccccacagattcaaggtgtacaactacaagagccccaccttctgcgagcactgcggcaccctgctgtggggcctggccagacagggcctgaagtgcgacgcctgcggcatgaacgtgcaccacagatgccagaccaaggtggccaacctgtgcggcatcaaccagaagctgatggccgaggccctggccatgatcgagagcacccagcaggccagatgcctgagagacaccgagcagatcttcagagagggccccgtggagatcggcctgccctgcagcatcaagaacgaggccagacccccctgcctgcccacccccggcaagagagagccccagggcatcagctgggagagccccctggacgaggtggacaagatgtgccacctgcccgagcccgagctgaacaaggagagacccagcctgcagatcaagctgaagatcgaggacttcatcctgcacaagatgctgggcaagggcagcttcggcaaggtgttcctggccgagttcaagaagaccaaccagttcttcgccatcaaggccctgaagaaggacgtggtgctgatggacgacgacgtggagtgcaccatggtggagaagagagtgctgagcctggcctgggagcaccccttcctgacccacatgttctgcaccttccagaccaaggagaacctgttcttcgtgatggagtacctgaacggcggcgacctgatgtaccacatccagagctgccacaagttcgacctgagcagagccaccttctacgccgccgagatcatcctgggcctgcagttcctgcacagcaagggcatcgtgtacagagacctgaagctggacaacatcctgctggacaaggacggccacatcaagatcgccgacttcggcatgtgcaaggagaacatgctgggcgacgccaagaccaacaccttctgcggcacccccgactacatcgcccccgagctgttcgtgagagagcccgagaagagactgggcgtgagaggcgacatcagacagcaccccctgttcagagagatcaactgggaggagctggagagaaaggagatcgacccccccttcagacccaaggtgaagagccccttcgactgcagcaacttcgacaaggagttcctgaacgagaagcccagactgagcttcgccgacagagccctgatcaacagcatggaccagaacatgttcagaaacttcagcttcatgaaccccggcatggagagactgatcagctag

SEQ ID NO: 95131 - DNA, 1440 bp, Artificial Sequence
  Description of Artificial Sequence: Synthetic coding sequence
tgactgagcctgctgccctgcctgctgttcctgcccaccatcatccccaagaagatcgtgatccagagagacagcctgcccagcaagaagctgagctacggcctgatcgcctgcggcatgaacgtgcaccacagatgccagaccaaggtggccaacctgtgcggcatcaaccagaagctgatggccgaggccctggccatgatcgagagcacccagcaggccagatgcctgagagacaccgagcagatcttcagagagggccccgtggagatcggcctgccctgcagcatcaagaacgaggccagacccccctgcctgcccacccccggcaagagagagccccagggcatcagctgggagagccccctggacgaggtggacaagatgtgccacctgcccgagcccgagctgaacaaggagagacccagcctgcagatcaagctgaagatcgaggacttcatcctgcacaagatgctgggcaagggcagcttcggcaaggtgttcctggccgagttcaagaagaccaaccagttcttcgccatcaaggccctgaagaaggacgtggtgctgatggacgacgacgtggagtgcaccatggtggagaagagagtgctgagcctggcctgggagcaccccttcctgacccacatgttctgcaccttccagaccaaggagaacctgttcttcgtgatggagtacctgaacggcggcgacctgatgtaccacatccagagctgccacaagttcgacctgagcagagccaccttctacgccgccgagatcatcctgggcctgcagttcctgcacagcaagggcatcgtgtacagagacctgaagctggacaacatcctgctggacaaggacggccacatcaagatcgccgacttcggcatgtgcaaggagaacatgctgggcgacgccaagaccaacaccttctgcggcacccccgactacatcgcccccgagatcctgctgggccagaagtacaaccacagcgtggactggtggagcttcggcgtgctgctgtacgagatgctgatcggccagagccccttccacggccaggacgaggaggagctgttccacagcatcagaatggacaaccccttctaccccagatggctggagaaggaggccaaggacctgctggtgaagctgttcgtgagagagcccgagaagagactgggcgtgagaggcgacatcagacagcaccccctgttcagagagatcaactgggaggagctggagagaaaggagatcgacccccccttcagacccaaggtgaagagccccttcgactgcagcaacttcgacaaggagttcctgaacgagaagcccagactgagcttcgccgacagagccctgatcaacagcatggaccagaacatgttcagaaacttcagcttcatgaaccccggcatggagagactgatcagctag

SEQ ID NO: 95132 - DNA, 1746 bp, Artificial Sequence
  Description of Artificial Sequence: Synthetic coding sequence
atggacaccaaggacatgaacgagttcgagaccgagggcttcttcgccctgcaccagagaagaggcgccatcaagcaggccaaggtgcaccacgtgaagtgccacgagttcaccgccaccttcttcccccagcccaccttctgcagcgtgtgccacgagttcgtgtggggcctgaacaagcagggctaccagtgcagacagtgcaacgccgccatccacaagaagtgcatcgacaaggtgatcgccaagtgcaccggcagcgccatcaacagcagagagaccatgttccacaaggagagattcaagatcgacatgccccacagattcaaggtgtacaactacaagagccccaccttctgcgagcactgcggcaccctgctgtggggcctggccagacagggcctgaagtgcgacgcctgcggcatgaacgtgcaccacagatgccagaccaaggtggccaacctgtgcggcatcaaccagaagctgatggccgaggccctggccatgatcgagagcacccagcaggccagatgcctgagagacaccgagcagatcttcagagagggccccgtggagatcggcctgccctgcagcatcaagaacgaggccagacccccctgcctgcccacccccggcaagagagagccccagggcatcagctgggagagccccctggacgaggtggacaagatgtgccacctgcccgagcccgagctgaacaaggagagacccagcctgcagatcaagctgaagatcgaggacttcatcctgcacaagatgctgggcaagggcagcttcggcaaggtgttcctggccgagttcaagaagaccaaccagttcttcgccatcaaggccctgaagaaggacgtggtgctgatggacgacgacgtggagtgcaccatggtggagaagagagtgctgagcctggcctgggagcaccccttcctgacccacatgttctgcaccttccagaccaaggagaacctgttcttcgtgatggagtacctgaacggcggcgacctgatgtaccacatccagagctgccacaagttcgacctgagcagagccaccttctacgccgccgagatcatcctgggcctgcagttcctgcacagcaagggcatcgtgtacagagacctgaagctggacaacatcctgctggacaaggacggccacatcaagatcgccgacttcggcatgtgcaaggagaacatgctgggcgacgccaagaccaacaccttctgcggcacccccgactacatcgcccccgagatcctgctgggccagaagtacaaccacagcgtggactggtggagcttcggcgtgctgctgtacgagatgctgatcggccagagccccttccacggccaggacgaggaggagctgttccacagcatcagaatggacaaccccttctaccccagatggctggagaaggaggccaaggacctgctggtgaagctgttcgtgagagagcccgagaagagactgggcgtgagaggcgacatcagacagcaccccctgttcagagagatcaactgggaggagctggagagaaaggagatcgacccccccttcagacccaaggtgaagagccccttcgactgcagcaacttcgacaaggagttcctgaacgagaagcccagactgagcttcgccgacagagccctgatcaacagcatggaccagaacatgttcagaaacttcagcttcatgaaccccggcatggagagactgatcagctag

SEQ ID NO: 95133 - DNA, 1032 bp, Artificial Sequence
  Description of Artificial Sequence: Synthetic coding sequence
atggccagcaacagcagcgacgtgaaggagttcctggccaaggccaaggaggacttcctgaagaagtgggagagccccgcccagaacaccgcccacctggaccagttcgagagaatcaagaccctgggcaccggcagcttcggcagagtgatgctggtgaagcacaaggagaccggcaaccactacgccatgaagatcctggacaagcagaaggtggtgaagctgaagcagatcgagcacaccctgaacgagaagagaatcctgcaggccgtgaacttccccttcctggtgaagctggagttcagcttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccagcagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgaacgacatcaagaaccacaagtggttcgccaccaccgactggatcgccatctaccagagaaaggtggaggcccccttcatccccaagttcaagggccccggcgacaccagcaacttcgacgactacgaggaggaggagatcagagtgagcatcaacgagaagtgcggcaaggagttcagcgagttctag

SEQ ID NO: 95134 - DNA, 1146 bp, Artificial Sequence
  Description of Artificial Sequence: Synthetic coding sequence
atggagagcggcagcaccgccgccagcgaggaggccagaagcctgagagagtgcgagctgtacgtgcagaagcacaacatccaggccctgctgaaggacagcatcgtgcagctgtgcaccgccagacccgagagacccatggccttcctgagagagtacttcgagagactggagaaggaggaggccaagcagatccagaacctgcagaaggccggcaccagaaccgacagcagagaggacgagatcagcccccccccccccaaccccgtggtgaagggcagaagaagaagaggcgccatcagcgccgaggtgtacaccgaggaggacgccgccagctacgtgagaaaggtgatccccaaggactacaagaccatggccgccctggccaaggccatcgagaagaacgtgctgttcagccacctggacgacaacgagagaagcgacatcttcgacgccatgttcagcgtgagcttcatcgccggcgagaccgtgatccagcagggcgacgagggcgacaacttctacgtgatcgaccagggcgagaccgacgtgtacgtgaacaacgagtgggccaccagcgtgggcgagggcggcagcttcggcgagctggccctgatctacggcacccccagagccgccaccgtgaaggccaagaccaacgtgaagctgtggggcatcgacagagacagctacagaagaatcctgatgggcagcaccctgagaaagagaaagatgtacgaggagttcctgagcaaggtgagcatcctggagagcctggacaagtgggagagactgaccgtggccgacgccctggagcccgtgcagttcgaggacggccagaagatcgtggtgcagggcgagcccggcgacgagttcttcatcatcctggagggcagcgccgccgtgctgcagagaagaagcgagaacgaggagttcgtggaggtgggcagactgggccccagcgactacttcggcgagatcgccctgctgatgaacagacccagagccgccaccgtggtggccagaggccccctgaagtgcgtgaagctggacagacccagattcgagagagtgctgggcccctgcagcgacatcctgaagagaaacatccagcagtacaacagcttcgtgagcctgagcgtgtag

SEQ ID NO: 95135 - DNA, 2739 bp, Artificial Sequence
  Description of Artificial Sequence: Synthetic coding sequence
atgagcgccccccccgtgctgagaccccccagccccctgctgcccgtggccgccgccgccgccgccgccgccgccgccctggtgcccggcagcggccccggccccgcccccttcctggcccccgtggccgcccccgtgggcggcatcagcttccacctgcagatcggcctgagcagagagcccgtgctgctgctgcaggacagcagcggcgactacagcctggcccacgtgagagagatggcctgcagcatcgtggaccagaagttccccgagtgcggcttctacggcatgtacgacaagatcctgctgttcagacacgaccccaccagcgagaacatcctgcagctggtgaaggccgccagcgacatccaggagggcgacctgatcgaggtggtgctgagcgccagcgccaccttcgaggacttccagatcagaccccacgccctgttcgtgcacagctacagagcccccgccttctgcgaccactgcggcgagatgctgtggggcctggtgagacagggcctgaagtgcgagggctgcggcctgaactaccacaagagatgcgccttcaagatccccaacaactgcagcggcgtgagaagaagaagactgagcaacgtgagcctgaccggcgtgagcaccatcagaaccagcagcgccgagctgagcaccagcgcccccgacgagcccctgctgcagaagagccccagcgagagcttcatcggcagagagaagagaagcaacagccagagctacatcggcagacccatccacctggacaagatcctgatgagcaaggtgaaggtgccccacaccttcgtgatccacagctacaccagacccaccgtgtgccagtactgcaagaagctgctgaagggcctgttcagacagggcctgcagtgcaaggactgcagattcaactgccacaagagatgcgcccccaaggtgcccaacaactgcctgggcgaggtgaccatcaacggcgacctgctgagccccggcgccgagagcgacgtggtgatggaggagggcagcgacgacaacgacagcgagagaaacagcggcctgatggacgacatggaggaggccatggtgcaggacgccgagatggccatggccgagtgccagaacgacagcggcgagatgcaggaccccgaccccgaccacgaggacgccaacagaaccatcagccccagcaccagcaacaacatccccctgatgagagtggtgcagagcgtgaagcacaccaagagaaagagcagcaccgtgatgaaggagggctggatggtgcactacaccagcaaggacaccctgagaaagagacactactggagactggacagcaagtgcatcaccctgttccagaacgacaccggcagcagatactacaaggagatccccctgagcgagatcctgagcctggagcccgtgaagaccagcgccctgatccccaacggcgccaacccccactgcttcgagatcaccaccgccaacgtggtgtactacgtgggcgagaacgtggtgaaccccagcagccccagccccaacaacagcgtgctgaccagcggcgtgggcgccgacgtggccagaatgtgggagatcgccatccagcacgccctgatgcccgtgatccccaagggcagcagcgtgggcaccggcaccaacctgcacagagacatcagcgtgagcatcagcgtgagcaactgccagatccaggagaacgtggacatcagcaccgtgtaccagatcttccccgacgaggtgctgggcagcggccagttcggcatcgtgtacggcggcaagcacagaaagaccggcagagacgtggccatcaagatcatcgacaagctgagattccccaccaagcaggagagccagctgagaaacgaggtggccatcctgcagaacctgcaccaccccggcgtggtgaacctggagtgcatgttcgagacccccgagagagtgttcgtggtgatggagaagctgcacggcgacatgctggagatgatcctgagcagcgagaagggcagactgcccgagcacatcaccaagttcctgatcacccagatcctggtggccctgagacacctgcacttcaagaacatcgtgcactgcgacctgaagcccgagaacgtgctgctggccagcgccgaccccttcccccaggtgaagctgtgcgacttcggcttcgccagaatcatcggcgagaagagcttcagaagaagcgtggtgggcacccccgcctacctggcccccgaggtgctgagaaacaagggctacaacagaagcctggacatgtggagcgtgggcgtgatcatctacgtgagcctgagcggcaccttccccttcaacgaggacgaggacatccacgaccagatccagaacgccgccttcatgtacccccccaacccctggaaggagatcagccacgaggccatcgacctgatcaacaacctgctgcaggtgaagatgagaaagagatacagcgtggacaagaccctgagccacccctggctgcaggactaccagacctggctggacctgagagagctggagtgcaagatcggcgagagatacatcacccacgagagcgacgacctgagatgggagaagtacgccggcgagcagggcctgcagtaccccacccacctgatcaaccccagcgccagccacagcgacacccccgagaccgaggagaccgagatgaaggccctgggcgagagagtgagcatcctgtag

SEQ ID NO: 95136 - DNA, 2637 bp, Artificial Sequence
  Description of Artificial Sequence: Synthetic coding sequence
atggccaccgcccccagctaccccgccggcctgcccggcagccccggccccggcagcccccccccccccggcggcctggagctgcagagccccccccccctgctgccccagatccccgcccccggcagcggcgtgagcttccacatccagatcggcctgaccagagagttcgtgctgctgcccgccgccagcgagctggcccacgtgaagcagctggcctgcagcatcgtggaccagaagttccccgagtgcggcttctacggcctgtacgacaagatcctgctgttcaagcacgaccccaccagcgccaacctgctgcagctggtgagaagcagcggcgacatccaggagggcgacctggtggaggtggtgctgagcgccagcgccaccttcgaggacttccagatcagaccccacgccctgaccgtgcacagctacagagcccccgccttctgcgaccactgcggcgagatgctgttcggcctggtgagacagggcctgaagtgcgacggctgcggcctgaactaccacaagagatgcgccttcagcatccccaacaactgcagcggcgccagaaagagaagactgagcagcaccagcctggccagcggccacagcgtgagactgggcaccagcgagagcctgccctgcaccgccgaggagctgagcagaagcaccaccgagctgctgcccagaagaccccccagcagcagcagcagcagcagcgccagcagctacaccggcagacccatcgagctggacaagatgctgctgagcaaggtgaaggtgccccacaccttcctgatccacagctacaccagacccaccgtgtgccaggcctgcaagaagctgctgaagggcctgttcagacagggcctgcagtgcaaggactgcaagttcaactgccacaagagatgcgccaccagagtgcccaacgactgcctgggcgaggccctgatcaacggcgacgtgcccatggaggaggccaccgacttcagcgaggccgacaagagcgccctgatggacgagagcgaggacagcggcgtgatccccggcagccacagcgagaacgccctgcacgccagcgaggaggaggagggcgagggcggcaaggcccagagcagcctgggctacatccccctgatgagagtggtgcagagcgtgagacacaccaccagaaagagcagcaccaccctgagagagggctgggtggtgcactacagcaacaaggacaccctgagaaagagacactactggagactggactgcaagtgcatcaccctgttccagaacaacaccaccaacagatactacaaggagatccccctgagcgagatcctgaccgtggagagcgcccagaacttcagcctggtgccccccggcaccaacccccactgcttcgagatcgtgaccgccaacgccacctacttcgtgggcgagatgcccggcggcacccccggcggccccagcggccagggcgccgaggccgccagaggctgggagaccgccatcagacaggccctgatgcccgtgatcctgcaggacgcccccagcgcccccggccacgccccccacagacaggccagcctgagcatcagcgtgagcaacagccagatccaggagaacgtggacatcgccaccgtgtaccagatcttccccgacgaggtgctgggcagcggccagttcggcgtggtgtacggcggcaagcacagaaagaccggcagagacgtggccgtgaaggtgatcgacaagctgagattccccaccaagcaggagagccagctgagaaacgaggtggccatcctgcagagcctgagacaccccggcatcgtgaacctggagtgcatgttcgagacccccgagaaggtgttcgtggtgatggagaagctgcacggcgacatgctggagatgatcctgagcagcgagaagggcagactgcccgagagactgaccaagttcctgatcacccagatcctggtggccctgagacacctgcacttcaagaacatcgtgcactgcgacctgaagcccgagaacgtgctgctggccagcgccgaccccttcccccaggtgaagctgtgcgacttcggcttcgccagaatcatcggcgagaagagcttcagaagaagcgtggtgggcacccccgcctacctggcccccgaggtgctgctgaaccagggctacaacagaagcctggacatgtggagcgtgggcgtgatcatgtacgtgagcctgagcggcaccttccccttcaacgaggacgaggacatcaacgaccagatccagaacgccgccttcatgtaccccgccagcccctggagccacatcagcgccggcgccatcgacctgatcaacaacctgctgcaggtgaagatgagaaagagatacagcgtggacaagagcctgagccacccctggctgcaggagtaccagacctggctggacctgagagagctggagggcaagatgggcgagagatacatcacccacgagagcgacgacgtgagatgggagcagttcgccgccgagcaccccctgcccggcagcggcctgcccaccgacagagacctgggcggcgcctgccccccccaggaccacgacatgcagggcctggccgagagaatcagcgtgctgtag

SEQ ID NO: 95137 - DNA, 2637 bp, Artificial Sequence; identical to SEQ ID NO: 95136
  Description of Artificial Sequence: Synthetic coding sequence

SEQ ID NO: 95138 - DNA, 2166 bp, Artificial Sequence
  Description of Artificial Sequence: Synthetic coding sequence
atgctgttcggcctggtgagacagggcctgaagtgcgacggctgcggcctgaactaccacaagagatgcgccttcagcatccccaacaactgcagcggcgccagaaagagaagactgagcagcaccagcctggccagcggccacagcgtgagactgggcaccagcgagagcctgccctgcaccgccgaggagctgagcagaagcaccaccgagctgctgcccagaagaccccccagcagcagcagcagcagcagcgccagcagctacaccggcagacccatcgagctggacaagatgctgctgagcaaggtgaaggtgccccacaccttcctgatccacagctacaccagacccaccgtgtgccaggcctgcaagaagctgctgaagggcctgttcagacagggcctgcagtgcaaggactgcaagttcaactgccacaagagatgcgccaccagagtgcccaacgactgcctgggcgaggccctgatcaacggcgacgtgcccatggaggaggccaccgacttcagcgaggccgacaagagcgccctgatggacgagagcgaggacagcggcgtgatccccggcagccacagcgagaacgccctgcacgccagcgaggaggaggagggcgagggcggcaaggcccagagcagcctgggctacatccccctgatgagagtggtgcagagcgtgagacacaccaccagaaagagcagcaccaccctgagagagggctgggtggtgcactacagcaacaaggacaccctgagaaagagacactactggagactggactgcaagtgcatcaccctgttccagaacaacaccaccaacagatactacaaggagatccccctgagcgagatcctgaccgtggagagcgcccagaacttcagcctggtgccccccggcaccaacccccactgcttcgagatcgtgaccgccaacgccacctacttcgtgggcgagatgcccggcggcacccccggcggccccagcggccagggcgccgaggccgccagaggctgggagaccgccatcagacaggccctgatgcccgtgatcctgcaggacgcccccagcgcccccggccacgccccccacagacaggccagcctgagcatcagcgtgagcaacagccagatccaggagaacgtggacatcgccaccgtgtaccagatcttccccgacgaggtgctgggcagcggccagttcggcgtggtgtacggcggcaagcacagaaagaccggcagagacgtggccgtgaaggtgatcgacaagctgagattccccaccaagcaggagagccagctgagaaacgaggtggccatcctgcagagcctgagacaccccggcatcgtgaacctggagtgcatgttcgagacccccgagaaggtgttcgtggtgatggagaagctgcacggcgacatgctggagatgatcctgagcagcgagaagggcagactgcccgagagactgaccaagttcctgatcacccagatcctggtggccctgagacacctgcacttcaagaacatcgtgcactgcgacctgaagcccgagaacgtgctgctggccagcgccgaccccttcccccaggtgaagctgtgcgacttcggcttcgccagaatcatcggcgagaagagcttcagaagaagcgtggtgggcacccccgcctacctggcccccgaggtgctgctgaaccagggctacaacagaagcctggacatgtggagcgtgggcgtgatcatgtacgtgagcctgagcggcaccttccccttcaacgaggacgaggacatcaacgaccagatccagaacgccgccttcatgtaccccgccagcccctggagccacatcagcgccggcgccatcgacctgatcaacaacctgctgcaggtgaagatgagaaagagatacagcgtggacaagagcctgagccacccctggctgcaggagtaccagacctggctggacctgagagagctggagggcaagatgggcgagagatacatcacccacgagagcgacgacgtgagatgggagcagttcgccgccgagcaccccctgcccggcagcggcctgcccaccgacagagacctgggcggcgcctgccccccccaggaccacgacatgcagggcctggccgagagaatcagcgtgctgtag

SEQ ID NO: 95139 - DNA, 1482 bp, Artificial Sequence
  Description of Artificial Sequence: Synthetic coding sequence
atgagaagaagaagagccgccgtggccgccggcttctgcgccagcttcctgctgggcagcgtgctgaacgtgctgttcgcccccggcagcgagccccccagacccggccagagccccgagcccagccccgcccccggccccggcagaagaggcggcagaggcgagctggccagacagatcagagccagatacgaggaggtgcagagatacagcagaggcggccccggccccggcgccggcagacccgagagaagaagactgatggacctggcccccggcggccccggcctgcccagacccagacccccctgggccagacccctgagcgacggcgcccccggctggccccccgcccccggccccggcagccccggccccggccccagactgggctgcgccgccctgagaaacgtgagcggcgcccagtacatgggcagcggctacaccaaggccgtgtacagagtgagactgcccggcggcgccgccgtggccctgaaggccgtggacttcagcggccacgacctgggcagctgcgtgagagagttcggcgtgagaagaggctgctacagactggccgcccacaagctgctgaaggagatggtgctgctggagagactgagacaccccaacgtgctgcagctgtacggctactgctaccaggacagcgaggacatccccgacaccctgaccaccatcaccgagctgggcgcccccgtggagatgatccagctgctgcagaccagctgggaggacagattcagaatctgcctgagcctgggcagactgctgcaccacctggcccacagccccctgggcagcgtgaccctgctggacttcagacccagacagttcgtgctggtggacggcgagctgaaggtgaccgacctggacgacgccagagtggaggagaccccctgcgccggcagcaccgactgcatcctggagttccccgccagaaacttcaccctgccctgcagcgcccagggctggtgcgagggcatgaacgagaagagaaacctgtacaacgcctacagattcttcttcacctacctgctgccccacagcgccccccccagcctgagacccctgctggacagcatcgtgaacgccaccggcgagctggcctggggcgtggacgagaccctggcccagctggagaaggtgctgcacctgtacagaagcggccagtacctgcagaacagcaccgccagcagcagcaccgagtaccagtgcatccccgacagcaccatcccccaggaggactacagatgctggcccagctaccaccacggcagctgcctgctgagcgtgttcaacctggccgaggccgtggacgtgtgcgagagccacgcccagtgcagagccttcgtggtgaccaaccagaccacctggaccggcagacagctggtgttcttcaagaccggctggagccaggtggtgcccgaccccaacaagaccacctacgtgaaggccagcggctag

SEQ ID NO: 95140 - DNA, 2829 bp, Artificial Sequence
  Description of Artificial Sequence: Synthetic coding sequence
atggccagcgacgccgtgcagagcgagcccagaagctggagcctgctggagcagctgggcctggccggcgccgacctggccgcccccggcgtgcagcagcagctggagctggagagagagagactgagaagagagatcagaaaggagctgaagctgaaggagggcgccgagaacctgagaagagccaccaccgacctgggcagaagcctgggccccgtggagctgctgctgagaggcagcagcagaagactggacctgctgcaccagcagctgcaggagctgcacgcccacgtggtgctgcccgaccccgccgccacccacgacggcccccagagccccggcgccggcggccccacctgcagcgccaccaacctgagcagagtggccggcctggagaagcagctggccatcgagctgaaggtgaagcagggcgccgagaacatgatccagacctacagcaacggcagcaccaaggacagaaagctgctgctgaccgcccagcagatgctgcaggacagcaagaccaagatcgacatcatcagaatgcagctgagaagagccctgcaggccggccagctggagaaccaggccgcccccgacgacacccagggcagccccgacctgggcgccgtggagctgagaatcgaggagctgagacaccacttcagagtggagcacgccgtggccgagggcgccaagaacgtgctgagactgctgagcgccgccaaggcccccgacagaaaggccgtgagcgaggcccaggagaagctgaccgagagcaaccagaagctgggcctgctgagagaggccctggagagaagactgggcgagctgcccgccgaccaccccaagggcagactgctgagagaggagctggccgccgccagcagcgccgccttcagcaccagactggccggccccttccccgccacccactacagcaccctgtgcaagcccgcccccctgaccggcaccctggaggtgagagtggtgggctgcagagacctgcccgagaccatcccctggaaccccacccccagcatgggcggccccggcacccccgacagcagaccccccttcctgagcagacccgccagaggcctgtacagcagaagcggcagcctgagcggcagaagcagcctgaaggccgaggccgagaacaccagcgaggtgagcaccgtgctgaagctggacaacaccgtggtgggccagaccagctggaagccctgcggccccaacgcctgggaccagagcttcaccctggagctggagagagccagagagctggagctggccgtgttctggagagaccagagaggcctgtgcgccctgaagttcctgaagctggaggacttcctggacaacgagagacacgaggtgcagctggacatggagccccagggctgcctggtggccgaggtgaccttcagaaaccccgtgatcgagagaatccccagactgagaagacagaagaagatcttcagcaagcagcagggcaaggccttccagagagccagacagatgaacatcgacgtggccacctgggtgagactgctgagaagactgatccccaacgccaccggcaccggcaccttcagccccggcgccagccccggcagcgaggccagaaccaccggcgacatcagcgtggagaagctgaacctgggcaccgacagcgacagcagcccccagaagagcagcagagacccccccagcagccccagcagcctgagcagccccatccaggagagcaccgcccccgagctgcccagcgagacccaggagacccccggccccgccctgtgcagccccctgagaaagagccccctgaccctggaggacttcaagttcctggccgtgctgggcagaggccacttcggcaaggtgctgctgagcgagttcagacccagcggcgagctgttcgccatcaaggccctgaagaagggcgacatcgtggccagagacgaggtggagagcctgatgtgcgagaagagaatcctggccgccgtgaccagcgccggccaccccttcctggtgaacctgttcggctgcttccagacccccgagcacgtgtgcttcgtgatggagtacagcgccggcggcgacctgatgctgcacatccacagcgacgtgttcagcgagcccagagccatcttctacagcgcctgcgtggtgctgggcctgcagttcctgcacgagcacaagatcgtgtacagagacctgaagctggacaacctgctgctggacaccgagggctacgtgaagatcgccgacttcggcctgtgcaaggagggcatgggctacggcgacagaaccagcaccttctgcggcacccccgagttcctggcccccgaggtgctgaccgacaccagctacaccagagccgtggactggtggggcctgggcgtgctgctgtacgagatgctggtgggcgagagccccttccccggcgacgacgaggaggaggtgttcgacagcatcgtgaacgacgaggtgagataccccagattcctgagcgccgaggccatcggcatcatgagaagactgctgagaagaaaccccgagagaagactgggcagcagcgagagagacgccgaggacgtgaagaagcagcccttcttcagaaccctgggctgggaggccctgctggccagaagactgcccccccccttcgtgcccaccctgagcggcagaaccgacgtgagcaacttcgacgaggagttcaccggcgaggcccccaccctgagcccccccagagacgccagacccctgaccgccgccgagcaggccgccttcctggacttcgacttcgtggccggcggctgctag

SEQ ID NO: 95141 - DNA, 2847 bp, Artificial Sequence
  Description of Artificial Sequence: Synthetic coding sequence
atggccgaggccaacaaccccagcgagcaggagctggagagcgagcccagaagctggagcctgctggagcagctgggcctggccggcgccgacctggccgcccccggcgtgcagcagcagctggagctggagagagagagactgagaagagagatcagaaaggagctgaagctgaaggagggcgccgagaacctgagaagagccaccaccgacctgggcagaagcctgggccccgtggagctgctgctgagaggcagcagcagaagactggacctgctgcaccagcagctgcaggagctgcacgcccacgtggtgctgcccgaccccgccgccacccacgacggcccccagagccccggcgccggcggccccacctgcagcgccaccaacctgagcagagtggccggcctggagaagcagctggccatcgagctgaaggtgaagcagggcgccgagaacatgatccagacctacagcaacggcagcaccaaggacagaaagctgctgctgaccgcccagcagatgctgcaggacagcaagaccaagatcgacatcatcagaatgcagctgagaagagccctgcaggccggccagctggagaaccaggccgcccccgacgacacccagggcagccccgacctgggcgccgtggagctgagaatcgaggagctgagacaccacttcagagtggagcacgccgtggccgagggcgccaagaacgtgctgagactgctgagcgccgccaaggcccccgacagaaaggccgtgagcgaggcccaggagaagctgaccgagagcaaccagaagctgggcctgctgagagaggccctggagagaagactgggcgagctgcccgccgaccaccccaagggcagactgctgagagaggagctggccgccgccagcagcgccgccttcagcaccagactggccggccccttccccgccacccactacagcaccctgtgcaagcccgcccccctgaccggcaccctggaggtgagagtggtgggctgcagagacctgcccgagaccatcccctggaaccccacccccagcatgggcggccccggcacccccgacagcagaccccccttcctgagcagacccgccagaggcctgtacagcagaagcggcagcctgagcggcagaagcagcctgaaggccgaggccgagaacaccagcgaggtgagcaccgtgctgaagctggacaacaccgtggtgggccagaccagctggaagccctgcggccccaacgcctgggaccagagcttcaccctggagctggagagagccagagagctggagctggccgtgttctggagagaccagagaggcctgtgcgccctgaagttcctgaagctggaggacttcctggacaacgagagacacgaggtgcagctggacatggagccccagggctgcctggtggccgaggtgaccttcagaaaccccgtgatcgagagaatccccagactgagaagacagaagaagatcttcagcaagcagcagggcaaggccttccagagagccagacagatgaacatcgacgtggccacctgggtgagactgctgagaagactgatccccaacgccaccggcaccggcaccttcagccccggcgccagccccggcagcgaggccagaaccaccggcgacatcagcgtggagaagctgaacctgggcaccgacagcgacagcagcccccagaagagcagcagagacccccccagcagccccagcagcctgagcagccccatccaggagagcaccgcccccgagctgcccagcgagacccaggagacccccggccccgccctgtgcagccccctgagaaagagccccctgaccctggaggacttcaagttcctggccgtgctgggcagaggccacttcggcaaggtgctgctgagcgagttcagacccagcggcgagctgttcgccatcaaggccctgaagaagggcgacatcgtggccagagacgaggtggagagcctgatgtgcgagaagagaatcctggccgccgtgaccagcgccggccaccccttcctggtgaacctgttcggctgcttccagacccccgagcacgtgtgcttcgtgatggagtacagcgccggcggcgacctgatgctgcacatccacagcgacgtgttcagcgagcccagagccatcttctacagcgcctgcgtggtgctgggcctgcagttcctgcacgagcacaagatcgtgtacagagacctgaagctggacaacctgctgctggacaccgagggctacgtgaagatcgccgacttcggcctgtgcaaggagggcatgggctacggcgacagaaccagcaccttctgcggcacccccgagttcctggcccccgaggtgctgaccgacaccagctacaccagagccgtggactggtggggcctgggcgtgctgctgtacgagatgctggtgggcgagagccccttccccggcgacgacgaggaggaggtgttcgacagcatcgtgaacgacgaggtgagataccccagattcctgagcgccgaggccatcggcatcatgagaagactgctgagaagaaaccccgagagaagactgggcagcagcgagagagacgccgaggacgtgaagaagcagcccttcttcagaaccctgggctgggaggccctgctggccagaagactgcccccccccttcgtgcccaccctgagcggcagaaccgacgtgagcaacttcgacgaggagttcaccggcgaggcccccaccctgagcccccccagagacgccagacccctgaccgccgccgagcaggccgccttcctggacttcgacttcgtggccggcggctgctag

SEQ ID NO: 95142 - DNA, 1815 bp, Artificial Sequence
  Description of Artificial Sequence: Synthetic coding sequence
atggccagcaaccccgagagaggcgagatcctgctgaccgagctgcagggcgacagcagaagcctgcccttcagcgagaacgtgagcgccgtgcagaagctggacttcagcgacaccatggtgcagcagaagctggacgacatcaaggacagaatcaagagagagatcagaaaggagctgaagatcaaggagggcgccgagaacctgagaaaggtgaccaccgacaagaagagcctggcctacgtggacaacatcctgaagaagagcaacaagaagctggaggagctgcaccacaagctgcaggagctgaacgcccacatcgtggtgagcgaccccgaggacatcaccgactgccccagaacccccgacacccccaacaacgaccccagatgcagcaccagcaacaacagactgaaggccctgcagaagcagctggacatcgagctgaaggtgaagcagggcgccgagaacatgatccagatgtacagcaacggcagcagcaaggacagaaagctgcacggcaccgcccagcagctgctgcaggacagcaagaccaagatcgaggtgatcagaatgcagatcctgcaggccgtgcagaccaacgagctggccttcgacaacgccaagcccgtgatcagccccctggagctgagaatggaggagctgagacaccacttcagaatcgagttcgccgtggccgagggcgccaagaacgtgatgaagctgctgggcagcggcaaggtgaccgacagaaaggccctgagcgaggcccaggccagattcaacgagagcagccagaagctggacctgctgaagtacagcctggagcagagactgaacgaggtgcccaagaaccaccccaagagcagaatcatcatcgaggagctgagcctggtggccgccagccccaccctgagccccagacagagcatgatcagcacccagaaccagtacagcaccctgagcaagcccgccgccctgaccggcaccctggaggtgagactgatgggctgccaggacatcctggagaacgtgcccggcagaagcaaggccaccagcgtggccctgcccggctggagccccagcgagaccagaagcagcttcatgagcagaaccagcaagagcaagagcggcagcagcagaaacctgctgaagaccgacgacctgagcaacgacgtgtgcgccgtgctgaagctggacaacaccgtggtgggccagaccagctggaagcccatcagcaaccagagctgggaccagaagttcaccctggagctggacagaagcagagagctggagatcagcgtgtactggagagactggagaagcctgtgcgccgtgaagttcctgagactggaggacttcctggacaaccagagacacggcatgtgcctgtacctggagccccagggcaccctgttcgccgaggtgaccttcttcaaccccgtgatcgagagaagacccaagctgcagagacagaagaagatcttcagcaagcagcagggcaagaccttcctgagagccccccagatgaacatcaacatcgccacctggggcagactggtgagaagagccatccccaccgtgaaccacagcggcaccttcagcccccaggcccccgtgcccaccaccgtgcccgtggtggacgtgagaatcccccagctggccccccccgccagatacgtgagcgagatcctgagcatcagctacaccaagctgctgggccacagctacgtgctgatcatcgccggcgtgctgagcctggccttcttccccagcagcatcctgaaggtggtgttctgcctgctgaagaagtag

SEQ ID NO: 95143 - DNA, 2484 bp, Artificial Sequence
  Description of Artificial Sequence: Synthetic coding sequence
atgatccagatgtacagcaacggcagcagcaaggacagaaagctgcacggcaccgcccagcagctgctgcaggacagcaagaccaagatcgaggtgatcagaatgcagatcctgcaggccgtgcagaccaacgagctggccttcgacaacgccaagcccgtgatcagccccctggagctgagaatggaggagctgagacaccacttcagaatcgagttcgccgtggccgagggcgccaagaacgtgatgaagctgctgggcagcggcaaggtgaccgacagaaaggccctgagcgaggcccaggccagattcaacgagagcagccagaagctggacctgctgaagtacagcctggagcagagactgaacgaggtgcccaagaaccaccccaagagcagaatcatcatcgaggagctgagcctggtggccgccagccccaccctgagccccagacagagcatgatcagcacccagaaccagtacagcaccctgagcaagcccgccgccctgaccggcaccctggaggtgagactgatgggctgccaggacatcctggagaacgtgcccggcagaagcaaggccaccagcgtggccctgcccggctggagccccagcgagaccagaagcagcttcatgagcagaaccagcaagagcaagagcggcagcagcagaaacctgctgaagaccgacgacctgagcaacgacgtgtgcgccgtgctgaagctggacaacaccgtggtgggccagaccagctggaagcccatcagcaaccagagctgggaccagaagttcaccctggagctggacagaagcagagagctggagatcagcgtgtactggagagactggagaagcctgtgcgccgtgaagttcctgagactggaggacttcctggacaaccagagacacggcatgtgcctgtacctggagccccagggcaccctgttcgccgaggtgaccttcttcaaccccgtgatcgagagaagacccaagctgcagagacagaagaagatcttcagcaagcagcagggcaagaccttcctgagagccccccagatgaacatcaacatcgccacctggggcagactggtgagaagagccatccccaccgtgaaccacagcggcaccttcagcccccaggcccccgtgcccaccaccgtgcccgtggtggacgtgagaatcccccagctggccccccccgccagcgacagcaccgtgaccaagctggacttcgacctggagcccgagcccccccccgccccccccagagccagcagcctgggcgagatcgacgagagcagcgagctgagagtgctggacatccccggccaggacagcgagaccgtgttcgacatccagaacgacagaaacagcatcctgcccaagagccagagcgagtacaagcccgacaccccccagagcggcctggagtacagcggcatccaggagctggaggacagaagaagccagcagagattccagttcaacctgcaggacttcagatgctgcgccgtgctgggcagaggccacttcggcaaggtgctgctggccgagtacaagaacaccaacgagatgttcgccatcaaggccctgaagaagggcgacatcgtggccagagacgaggtggacagcctgatgtgcgagaagagaatcttcgagaccgtgaacagcgtgagacaccccttcctggtgaacctgttcgcctgcttccagaccaaggagcacgtgtgcttcgtgatggagtacgccgccggcggcgacctgatgatgcacatccacaccgacgtgttcagcgagcccagagccgtgttctacgccgcctgcgtggtgctgggcctgcagtacctgcacgagcacaagatcgtgtacagagacctgaagctggacaacctgctgctggacaccgagggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagagccccttccccggcgacgacgaggaggaggtgttcgacagcatcgtgaacgacgaggtgagataccccagattcctgagcaccgaggccatcagcatcatgagaagactgctgagaagaaaccccgagagaagactgggcgccagcgagaaggacgccgaggacgtgaagaagcaccccttcttcagactgatcgactggagcgccctgatggacaagaaggtgaagccccccttcatccccaccatcagaggcagagaggacgtgagcaacttcgacgacgagttcaccagcgaggcccccatcctgaccccccccagagagcccagaatcctgagcgaggaggagcaggagatgttcagagacttcgactacatcgccgactggtgctag

SEQ ID NO: 95144 - DNA, 2811 bp, Artificial Sequence
  Description of Artificial Sequence: Synthetic coding sequence
atggccagcaaccccgagagaggcgagatcctgctgaccgagctgcagggcgacagcagaagcctgcccttcagcgagaacgtgagcgccgtgcagaagctggacttcagcgacaccatggtgcagcagaagctggacgacatcaaggacagaatcaagagagagatcagaaaggagctgaagatcaaggagggcgccgagaacctgagaaaggtgaccaccgacaagaagagcctggcctacgtggacaacatcctgaagaagagcaacaagaagctggaggagctgcaccacaagctgcaggagctgaacgcccacatcgtggtgagcgaccccgaggacatcaccgactgccccagaacccccgacacccccaacaacgaccccagatgcagcaccagcaacaacagactgaaggccctgcagaagcagctggacatcgagctgaaggtgaagcagggcgccgagaacatgatccagatgtacagcaacggcagcagcaaggacagaaagctgcacggcaccgcccagcagctgctgcaggacagcaagaccaagatcgaggtgatcagaatgcagatcctgcaggccgtgcagaccaacgagctggccttcgacaacgccaagcccgtgatcagccccctggagctgagaatggaggagctgagacaccacttcagaatcgagttcgccgtggccgagggcgccaagaacgtgatgaagctgctgggcagcggcaaggtgaccgacagaaaggccctgagcgaggcccaggccagattcaacgagagcagccagaagctggacctgctgaagtacagcctggagcagagactgaacgaggtgcccaagaaccaccccaagagcagaatcatcatcgaggagctgagcctggtggccgccagccccaccctgagccccagacagagcatgatcagcacccagaaccagtacagcaccctgagcaagcccgccgccctgaccggcaccctggaggtgagactgatgggctgccaggacatcctggagaacgtgcccggcagaagcaaggccaccagcgtggccctgcccggctggagccccagcgagaccagaagcagcttcatgagcagaaccagcaagagcaagagcggcagcagcagaaacctgctgaagaccgacgacctgagcaacgacgtgtgcgccgtgctgaagctggacaacaccgtggtgggccagaccagctggaagcccatcagcaaccagagctgggaccagaagttcaccctggagctggacagagtgaccttcttcaaccccgtgatcgagagaagacccaagctgcagagacagaagaagatcttcagcaagcagcagggcaagaccttcctgagagccccccagatgaacatcaacatcgccacctggggcagactggtgagaagagccatccccaccgtgaaccacagcggcaccttcagcccccaggcccccgtgcccaccaccgtgcccgtggtggacgtgagaatcccccagctggccccccccgccagcgacagcaccgtgaccaagctggacttcgacctggagcccgagcccccccccgccccccccagagccagcagcctgggcgagatcgacgagagcagcgagctgagagtgctggacatccccggccaggacagcgagaccgtgttcgacatccagaacgacagaaacagcatcctgcccaagagccagagcgagtacaagcccgacaccccccagagcggcctggagtacagcggcatccaggagctggaggacagaagaagccagcagagattccagttcaacctgcaggacttcagatgctgcgccgtgctgggcagaggccacttcggcaaggtgctgctggccgagtacaagaacaccaacgagatgttcgccatcaaggccctgaagaagggcgacatcgtggccagagacgaggtggacagcctgatgtgcgagaagagaatcttcgagaccgtgaacagcgtgagacaccccttcctggtgaacctgttcgcctgcttccagaccaaggagcacgtgtgcttcgtgatggagtacgccgccggcggcgacctgatgatgcacatccacaccgacgtgttcagcgagcccagagccgtgttctacgccgcctgcgtggtgctgggcctgcagtacctgcacgagcacaagatcgtgtacagagacctgaagctggacaacctgctgctggacaccgagggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagagccccttccccggcgacgacgaggaggaggtgttcgacagcatcgtgaacgacgaggtgagataccccagattcctgagcaccgaggccatcagcatcatgagaagactgctgagaagaaaccccgagagaagactgggcgccagcgagaaggacgccgaggacgtgaagaagcaccccttcttcagactgatcgactggagcgccctgatggacaagaaggtgaagccccccttcatccccaccatcagaggcagagaggacgtgagcaacttcgacgacgagttcaccagcgaggcccccatcctgaccccccccagagagcccagaatcctgagcgaggaggagcaggagatgttcagagacttcgactacatcgccgactggtgctag

SEQ ID NO: 95145 - DNA, 2955 bp, Artificial Sequence
  Description of Artificial Sequence: Synthetic coding sequence
atggccagcaaccccgagagaggcgagatcctgctgaccgagctgcagggcgacagcagaagcctgcccttcagcgagaacgtgagcgccgtgcagaagctggacttcagcgacaccatggtgcagcagaagctggacgacatcaaggacagaatcaagagagagatcagaaaggagctgaagatcaaggagggcgccgagaacctgagaaaggtgaccaccgacaagaagagcctggcctacgtggacaacatcctgaagaagagcaacaagaagctggaggagctgcaccacaagctgcaggagctgaacgcccacatcgtggtgagcgaccccgaggacatcaccgactgccccagaacccccgacacccccaacaacgaccccagatgcagcaccagcaacaacagactgaaggccctgcagaagcagctggacatcgagctgaaggtgaagcagggcgccgagaacatgatccagatgtacagcaacggcagcagcaaggacagaaagctgcacggcaccgcccagcagctgctgcaggacagcaagaccaagatcgaggtgatcagaatgcagatcctgcaggccgtgcagaccaacgagctggccttcgacaacgccaagcccgtgatcagccccctggagctgagaatggaggagctgagacaccacttcagaatcgagttcgccgtggccgagggcgccaagaacgtgatgaagctgctgggcagcggcaaggtgaccgacagaaaggccctgagcgaggcccaggccagattcaacgagagcagccagaagctggacctgctgaagtacagcctggagcagagactgaacgaggtgcccaagaaccaccccaagagcagaatcatcatcgaggagctgagcctggtggccgccagccccaccctgagccccagacagagcatgatcagcacccagaaccagtacagcaccctgagcaagcccgccgccctgaccggcaccctggaggtgagactgatgggctgccaggacatcctggagaacgtgcccggcagaagcaaggccaccagcgtggccctgcccggctggagccccagcgagaccagaagcagcttcatgagcagaaccagcaagagcaagagcggcagcagcagaaacctgctgaagaccgacgacctgagcaacgacgtgtgcgccgtgctgaagctggacaacaccgtggtgggccagaccagctggaagcccatcagcaaccagagctgggaccagaagttcaccctggagctggacagaagcagagagctggagatcagcgtgtactggagagactggagaagcctgtgcgccgtgaagttcctgagactggaggacttcctggacaaccagagacacggcatgtgcctgtacctggagccccagggcaccctgttcgccgaggtgaccttcttcaaccccgtgatcgagagaagacccaagctgcagagacagaagaagatcttcagcaagcagcagggcaagaccttcctgagagccccccagatgaacatcaacatcgccacctggggcagactggtgagaagagccatccccaccgtgaaccacagcggcaccttcagcccccaggcccccgtgcccaccaccgtgcccgtggtggacgtgagaatcccccagctggccccccccgccagcgacagcaccgtgaccaagctggacttcgacctggagcccgagcccccccccgccccccccagagccagcagcctgggcgagatcgacgagagcagcgagctgagagtgctggacatccccggccaggacagcgagaccgtgttcgacatccagaacgacagaaacagcatcctgcccaagagccagagcgagtacaagcccgacaccccccagagcggcctggagtacagcggcatccaggagctggaggacagaagaagccagcagagattccagttcaacctgcaggacttcagatgctgcgccgtgctgggcagaggccacttcggcaaggtgctgctggccgagtacaagaacaccaacgagatgttcgccatcaaggccctgaagaagggcgacatcgtggccagagacgaggtggacagcctgatgtgcgagaagagaatcttcgagaccgtgaacagcgtgagacaccccttcctggtgaacctgttcgcctgcttccagaccaaggagcacgtgtgcttcgtgatggagtacgccgccggcggcgacctgatgatgcacatccacaccgacgtgttcagcgagcccagagccgtgttctacgccgcctgcgtggtgctgggcctgcagtacctgcacgagcacaagatcgtgtacagagacctgaagctggacaacctgctgctggacaccgagggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagagccccttccccggcgacgacgaggaggaggtgttcgacagcatcgtgaacgacgaggtgagataccccagattcctgagcaccgaggccatcagcatcatgagaagactgctgagaagaaaccccgagagaagactgggcgccagcgagaaggacgccgaggacgtgaagaagcaccccttcttcagactgatcgactggagcgccctgatggacaagaaggtgaagccccccttcatccccaccatcagaggcagagaggacgtgagcaacttcgacgacgagttcaccagcgaggcccccatcctgaccccccccagagagcccagaatcctgagcgaggaggagcaggagatgttcagagacttcgactacatcgccgactggtgctag

SEQ ID NO: 95146 - DNA, 636 bp, Artificial Sequence
  Description of Artificial Sequence: Synthetic coding sequence
tgagaggagctgagacaccacttcagaatcgagttcgccgtggccgagggcgccaagaacgtgatgaagctgctgggcagcggcaaggtgaccgacagaaaggccctgagcgaggcccaggccagattcaacgagagcagccagaagctggacctgctgaagtacagcctggagcagagactgaacgaggtgcccaagaaccaccccaagagcagaatcatcatcgaggagctgagcctggtggccgccagccccaccctgagccccagacagagcatgatcagcacccagaaccagtacagcaccctgagcaagcccgccgccctgaccgacgacgtgtgcgccgtgctgaagctggacaacaccgtggtgggccagaccagctggaagcccatcagcaaccagagctgggaccagaagttcaccctggagctggacagaagcagagagctggagatcagcgtgtactggagagactggagaagcctgtgcgccgtgaagttcctgagactggaggacttcctggacaaccagagacacggcatgtgcctgtacctggagccccagggcaccctgttcgccgaggtgaccttcttcaaccccgtgatcgagagaagacccaagctgcagagatag

SEQ ID NO: 95147 - DNA, 198 bp, Artificial Sequence
  Description of Artificial Sequence: Synthetic coding sequence
tgaggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagaccagcgtgtag

SEQ ID NO: 95148 - DNA, 1977 bp, Artificial Sequence
  Description of Artificial Sequence: Synthetic coding sequence
atgaacagcaccctggaggtgagactgatgggctgccaggacatcctggagaacgtgcccggcagaagcaaggccaccagcgtggccctgcccggctggagccccagcgagaccagaagcagcttcatgagcagaaccagcaagagcaagagcggcagcagcagaaacctgctgaagaccgacgacctgagcaacgacgtgtgcgccgtgctgaagctggacaacaccgtggtgggccagaccagctggaagcccatcagcaaccagagctgggaccagaagttcaccctggagctggacagaagcagagagctggagatcagcgtgtactggagagactggagaagcctgtgcgccgtgaagttcctgagactggaggacttcctggacaaccagagacacggcatgtgcctgtacctggagccccagggcaccctgttcgccgaggtgaccttcttcaaccccgtgatcgagagaagacccaagctgcagagacagaagaagatcttcagcaagcagcagggcaagaccttcctgagagccccccagatgaacatcaacatcgccacctggggcagactggtgagaagagccatccccaccgtgaaccacagcggcaccttcagcccccaggcccccgtgcccaccaccgtgcccgtggtggacgtgagaatcccccagctggccccccccgccagcgacagcaccgtgaccaagctggacttcgacctggagcccgagcccccccccgccccccccagagccagcagcctgggcgagatcgacgagagcagcgagctgagagtgctggacatccccggccaggacagcgagaccgtgttcgacatccagaacgacagaaacagcatcctgcccaagagccagagcgagtacaagcccgacaccccccagagcggcctggagtacagcggcatccaggagctggaggacagaagaagccagcagagattccagttcaacctgcaggacttcagatgctgcgccgtgctgggcagaggccacttcggcaaggtgctgctggccgagtacaagaacaccaacgagatgttcgccatcaaggccctgaagaagggcgacatcgtggccagagacgaggtggacagcctgatgtgcgagaagagaatcttcgagaccgtgaacagcgtgagacaccccttcctggtgaacctgttcgcctgcttccagaccaaggagcacgtgtgcttcgtgatggagtacgccgccggcggcgacctgatgatgcacatccacaccgacgtgttcagcgagcccagagccgtgttctacgccgcctgcgtggtgctgggcctgcagtacctgcacgagcacaagatcgtgtacagagacctgaagctggacaacctgctgctggacaccgagggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagagccccttccccggcgacgacgaggaggaggtgttcgacagcatcgtgaacgacgaggtgagataccccagattcctgagcaccgaggccatcagcatcatgagaagactgctgagaagaaaccccgagagaagactgggcgccagcgagaaggacgccgaggacgtgaagaagcaccccttcttcagactgatcgactggagcgccctgatggacaagaaggtgaagccccccttcatccccaccatcagaggcagagaggacgtgagcaacttcgacgacgagttcaccagcgaggcccccatcctgaccccccccagagagcccagaatcctgagcgaggaggagcaggagatgttcagagacttcgactacatcgccgactggtgctag

SEQ ID NO: 95149 - DNA, 336 bp, Artificial Sequence
  Description of Artificial Sequence: Synthetic coding sequence
atgcacatccacaccgacgtgttcagcgagcccagagccgtgttctacgccgcctgcgtggtgctgggcctgcagtacctgcacgagcacaagatcgtgtacagagacctgaagctggacaacctgctgctggacaccgagggcttcgtgaagatcgccgacttcggcctgtgcaaggagggcatgggctacggcgacagaaccagcaccttctgcggcacccccgagttcctggcccccgaggtgctgaccgagaccagctacaccagagccgtggactggtggggcctgggcgtgctgatctacgagatgctggtgggcgagaccagcgtgtag

SEQ ID NO: 95150 - DNA, 2670 bp, Artificial Sequence
  Description of Artificial Sequence: Synthetic coding sequence
atggaggagggcgcccccagacagcccggccccagccagtggccccccgaggacgagaaggaggtgatcagaagagccatccagaaggagctgaagatcaaggagggcgtggagaacctgagaagagtggccaccgacagaagacacctgggccacgtgcagcagctgctgagaagcagcaacagaagactggagcagctgcacggcgagctgagagagctgcacgccagaatcctgctgcccggccccggccccggccccgccgagcccgtggccagcggccccagaccctgggccgagcagctgagagccagacacctggaggccctgagaagacagctgcacgtggagctgaaggtgaagcagggcgccgagaacatgacccacacctgcgccagcggcacccccaaggagagaaagctgctggccgccgcccagcagatgctgagagacagccagctgaaggtggccctgctgagaatgaagatcagcagcctggaggccagcggcagccccgagcccggccccgagctgctggccgaggagctgcagcacagactgcacgtggaggccgccgtggccgagggcgccaagaacgtggtgaagctgctgagcagcagaagaacccaggacagaaaggccctggccgaggcccaggcccagctgcaggagagcagccagaagctggacctgctgagactggccctggagcagctgctggagcagctgccccccgcccaccccctgagaagcagagtgaccagagagctgagagccgccgtgcccggctacccccagcccagcggcacccccgtgaagcccaccgccctgaccggcaccctgcaggtgagactgctgggctgcgagcagctgctgaccgccgtgcccggcagaagccccgccgccgccctggccagcagccccagcgagggctggctgagaaccaaggccaagcaccagagaggcagaggcgagctggccagcgaggtgctggccgtgctgaaggtggacaacagagtggtgggccagaccggctggggccaggtggccgagcagagctgggaccagaccttcgtgatccccctggagagagccagagagctggagatcggcgtgcactggagagactggagacagctgtgcggcgtggccttcctgagactggaggacttcctggacaacgcctgccaccagctgagcctgagcctggtgccccagggcctgctgttcgcccaggtgaccttctgcgaccccgtgatcgagagaagacccagactgcagagacaggagagaatcttcagcaagagaagaggccaggacttcctgagagccagccagatgaacctgggcatggccgcctggggcagactggtgatgaacctgctgcccccctgcagcagccccagcaccatcagcccccccaagggctgccccagaacccccaccaccctgagagaggccagcgaccccgccacccccagcaacttcctgcccaagaagacccccctgggcgaggagatgacccccccccccaagccccccagactgtacctgccccaggagcccaccagcgaggagacccccagaaccaagagaccccacatggagcccagaaccagaagaggccccagcccccccgccagccccaccagaaagccccccagactgcaggacttcagatgcctggccgtgctgggcagaggccacttcggcaaggtgctgctggtgcagttcaagggcaccggcaagtactacgccatcaaggccctgaagaagcaggaggtgctgagcagagacgagatcgagagcctgtactgcgagaagagaatcctggaggccgtgggctgcaccggccaccccttcctgctgagcctgctggcctgcttccagaccagcagccacgcctgcttcgtgaccgagttcgtgcccggcggcgacctgatgatgcagatccacgaggacgtgttccccgagccccaggccagattctacgtggcctgcgtggtgctgggcctgcagttcctgcacgagaagaagatcatctacagagacctgaagctggacaacctgctgctggacgcccagggcttcctgaagatcgccgacttcggcctgtgcaaggagggcatcggcttcggcgacagaaccagcaccttctgcggcacccccgagttcctggcccccgaggtgctgacccaggaggcctacaccagagccgtggactggtggggcctgggcgtgctgctgtacgagatgctggtgggcgagtgccccttccccggcgacaccgaggaggaggtgttcgactgcatcgtgaacatggacgccccctaccccggcttcctgagcgtgcagggcctggagttcatccagaagctgctgcagaagtgccccgagaagagactgggcgccggcgagcaggacgccgaggagatcaaggtgcagcccttcttcagaaccaccaactggcaggccctgctggccagaaccatccagccccccttcgtgcccaccctgtgcggccccgccgacctgagatacttcgagggcgagttcaccggcctgccccccgccctgaccccccccgccccccacagcctgctgaccgccagacagcaggccgccttcagagacttcgacttcgtgagcgagagattcctggagccctag

SEQ ID NO: 95151 - DNA, 1725 bp, Artificial Sequence
  Description of Artificial Sequence: Synthetic coding sequence
atgagaagactgagcagctggagaaagatggccaccgccgagaagcagaagcacgacggcagagtgaagatcggccactacatcctgggcgacaccctgggcgtgggcaccttcggcaaggtgaaggtgggcaagcacgagctgaccggccacaaggtggccgtgaagatcctgaacagacagaagatcagaagcctggacgtggtgggcaagatcagaagagagatccagaacctgaagctgttcagacacccccacatcatcaagctgtaccaggtgatcagcacccccagcgacatcttcatggtgatggagtacgtgagcggcggcgagctgttcgactacatctgcaagaacggcagaaagagcgacgtgcccggcgtggtgaagaccggcagcaccaaggagctggacgagaaggagagcagaagactgttccagcagatcctgagcggcgtggactactgccacagacacatggtggtgcacagagacctgaagcccgagaacgtgctgctggacgcccacatgaacgccaagatcgccgacttcggcctgagcaacatgatgagcgacggcgagttcctgagaaccagctgcggcagccccaactacgccgcccccgaggtgatcagcggcagactgtacgccggccccgaggtggacatctggagcagcggcgtgatcctgtacgccctgctgtgcggcaccctgcccttcgacgacgaccacgtgcccaccctgttcaagaagatctgcgacggcatcttctacaccccccagtacctgaaccccagcgtgatcagcctgctgaagcacatgctgcaggtggaccccatgaagagagccaccatcaaggacatcagagagcacgagtggttcaagcaggacctgcccaagtacctgttccccgaggaccccagctacagcagcaccatgatcgacgacgaggccctgaaggaggtgtgcgagaagttcgagtgcagcgaggaggaggtgctgagctgcctgtacaacagaaaccaccaggaccccctggccgtggcctaccacctgatcatcgacaacagaagaatcatgaacgaggccaaggacttctacctggccaccagcccccccgacagcttcctggacgaccaccacctgaccagaccccaccccgagagagtgcccttcctggtggccgagacccccagagccagacacaccctggacgagctgaacccccagaagagcaagcaccagggcgtgagaaaggccaagtggcacctgggcatcagaagccagagcagacccaacgacatcatggccgaggtgtgcagagccatcaagcagctggactacgagtggaaggtggtgaacccctactacctgagagtgagaagaaagaaccccgtgaccagcacctacagcaagatgagcctgcagctgtaccaggtggacagcagaacctacctgctggacttcagaagcatcgacgacgagatcaccgaggccaagagcggcaccgccaccccccagagaagcggcagcgtgagcaactacagaagctgccagagaagcgacagcgacgccgaggcccagggcaagagcagcgaggtgagcctgaccagcagcgtgaccagcctggacagcagccccgtggacctgacccccagacccggcagccacaccatcgagttcttcgagatgtgcgccaacctgatcaagatcctggcccagtag

SEQ ID NO: 95152 - DNA, 1680 bp, Artificial Sequence
  Description of Artificial Sequence: Synthetic coding sequence
atgagaagactgagcagctggagaaagatggccaccgccgagaagcagaagcacgacggcagagtgaagatcggccactacatcctgggcgacaccctgggcgtgggcaccttcggcaaggtgaaggtgggcaagcacgagctgaccggccacaaggtggccgtgaagatcctgaacagacagaagatcagaagcctggacgtggtgggcaagatcagaagagagatccagaacctgaagctgttcagacacccccacatcatcaagctgtaccaggtgatcagcacccccagcgacatcttcatggtgatggagtacgtgagcggcggcgagctgttcgactacatctgcaagaacggcagactggacgagaaggagagcagaagactgttccagcagatcctgagcggcgtggactactgccacagacacatggtggtgcacagagacctgaagcccgagaacgtgctgctggacgcccacatgaacgccaagatcgccgacttcggcctgagcaacatgatgagcgacggcgagttcctgagaaccagctgcggcagccccaactacgccgcccccgaggtgatcagcggcagactgtacgccggccccgaggtggacatctggagcagcggcgtgatcctgtacgccctgctgtgcggcaccctgcccttcgacgacgaccacgtgcccaccctgttcaagaagatctgcgacggcatcttctacaccccccagtacctgaaccccagcgtgatcagcctgctgaagcacatgctgcaggtggaccccatgaagagagccaccatcaaggacatcagagagcacgagtggttcaagcaggacctgcccaagtacctgttccccgaggaccccagctacagcagcaccatgatcgacgacgaggccctgaaggaggtgtgcgagaagttcgagtgcagcgaggaggaggtgctgagctgcctgtacaacagaaaccaccaggaccccctggccgtggcctaccacctgatcatcgacaacagaagaatcatgaacgaggccaaggacttctacctggccaccagcccccccgacagcttcctggacgaccaccacctgaccagaccccaccccgagagagtgcccttcctggtggccgagacccccagagccagacacaccctggacgagctgaacccccagaagagcaagcaccagggcgtgagaaaggccaagtggcacctgggcatcagaagccagagcagacccaacgacatcatggccgaggtgtgcagagccatcaagcagctggactacgagtggaaggtggtgaacccctactacctgagagtgagaagaaagaaccccgtgaccagcacctacagcaagatgagcctgcagctgtaccaggtggacagcagaacctacctgctggacttcagaagcatcgacgacgagatcaccgaggccaagagcggcaccgccaccccccagagaagcggcagcgtgagcaactacagaagctgccagagaagcgacagcgacgccgaggcccagggcaagagcagcgaggtgagcctgaccagcagcgtgaccagcctggacagcagccccgtggacctgacccccagacccggcagccacaccatcgagttcttcgagatgtgcgccaacctgatcaagatcctggcccagtag

SEQ ID NO: 95153 - DNA, 1659 bp, Artificial Sequence
  Description of Artificial Sequence: Synthetic coding sequence
atggccgagaagcagaagcacgacggcagagtgaagatcggccactacgtgctgggcgacaccctgggcgtgggcaccttcggcaaggtgaagatcggcgagcaccagctgaccggccacaaggtggccgtgaagatcctgaacagacagaagatcagaagcctggacgtggtgggcaagatcaagagagagatccagaacctgaagctgttcagacacccccacatcatcaagctgtaccaggtgatcagcacccccaccgacttcttcatggtgatggagtacgtgagcggcggcgagctgttcgactacatctgcaagcacggcagagtggaggagatggaggccagaagactgttccagcagatcctgagcgccgtggactactgccacagacacatggtggtgcacagagacctgaagcccgagaacgtgctgctggacgcccacatgaacgccaagatcgccgacttcggcctgagcaacatgatgagcgacggcgagttcctgagaaccagctgcggcagccccaactacgccgcccccgaggtgatcagcggcagactgtacgccggccccgaggtggacatctggagctgcggcgtgatcctgtacgccctgctgtgcggcaccctgcccttcgacgacgagcacgtgcccaccctgttcaagaagatcagaggcggcgtgttctacatccccgagtacctgaacagaagcgtggccaccctgctgatgcacatgctgcaggtggaccccctgaagagagccaccatcaaggacatcagagagcacgagtggttcaagcaggacctgcccagctacctgttccccgaggaccccagctacgacgccaacgtgatcgacgacgaggccgtgaaggaggtgtgcgagaagttcgagtgcaccgagagcgaggtgatgaacagcctgtacagcggcgacccccaggaccagctggccgtggcctaccacctgatcatcgacaacagaagaatcatgaaccaggccagcgagttctacctggccagcagcccccccagcggcagcttcatggacgacagcgccatgcacatcccccccggcctgaagccccaccccgagagaatgccccccctgatcgccgacagccccaaggccagatgccccctggacgccctgaacaccaccaagcccaagagcctggccgtgaagaaggccaagtggcacctgggcatcagaagccagagcaagccctacgacatcatggccgaggtgtacagagccatgaagcagctggacttcgagtggaaggtggtgaacgcctaccacctgagagtgagaagaaagaaccccgtgaccggcaactacgtgaagatgagcctgcagctgtacctggtggacaacagaagctacctgctggacttcaagagcatcgacgacgaggtggtggagcagagaagcggcagcagcaccccccagagaagctgcagcgccgccggcctgcacagacccagaagcagcttcgacagcaccaccgccgagagccacagcctgagcggcagcctgaccggcagcctgaccggcagcaccctgagcagcgtgagccccagactgggcagccacaccatggacttcttcgagatgtgcgccagcctgatcaccaccctggccagatag

SEQ ID NO: 95154 - DNA, 744 bp, Artificial Sequence
  Description of Artificial Sequence: Synthetic coding sequence
atgctgaccatcaccgacttcatcaacatcctgcacagatactacaagagcgccctggtgcagatctacgagctggaggagcacaagatcgagacctggagagaggtgtacctgcaggacagcttcaagcccctggtgtgcatcagccccaacgccagcctgttcgacgccgtgagcagcctgatcagaaacaagatccacagactgcccgtgatcgaccccgagagcggcaacaccctgtacatcctgacccacaagagaatcctgaagttcctgaagctgttcatcaccgagttccccaagcccgagttcatgagcaagagcctggaggagctgcagatcggcacctacgccaacatcgccatggtgagaaccaccacccccgtgtacgtggccctgggcatcttcgtgcagcacagagtgagcgccctgcccgtggtggacgagaagggcagagtggtggacatctacagcaagttcgacgtgatcaacctggccgccgagaagacctacaacaacctggacgtgagcgtgaccaaggccctgcagcacagaagccactacttcgagggcgtgctgaagtgctacctgcacgagaccctggagaccatcatcaacagactggtggaggccgaggtgcacagactggtggtggtggacgagaacgacgtggtgaagggcatcgtgagcctgagcgacatcctgcaggccctggtgctgaccggcggcgagaagaagccctag

SEQ ID NO: 95155 - DNA, 996 bp, Artificial Sequence
  Description of Artificial Sequence: Synthetic coding sequence
atggagaccgtgatcagcagcgacagcagccccgccgtggagaacgagcacccccaggagacccccgagagcaacaacagcgtgtacaccagcttcatgaagagccacagatgctacgacctgatccccaccagcagcaagctggtggtgttcgacaccagcctgcaggtgaagaaggccttcttcgccctggtgaccaacggcgtgagagccgcccccctgtgggacagcaagaagcagagcttcgtgggcatgctgaccatcaccgacttcatcaacatcctgcacagatactacaagagcgccctggtgcagatctacgagctggaggagcacaagatcgagacctggagagaggtgtacctgcaggacagcttcaagcccctggtgtgcatcagccccaacgccagcctgttcgacgccgtgagcagcctgatcagaaacaagatccacagactgcccgtgatcgaccccgagagcggcaacaccctgtacatcctgacccacaagagaatcctgaagttcctgaagctgttcatcaccgagttccccaagcccgagttcatgagcaagagcctggaggagctgcagatcggcacctacgccaacatcgccatggtgagaaccaccacccccgtgtacgtggccctgggcatcttcgtgcagcacagagtgagcgccctgcccgtggtggacgagaagggcagagtggtggacatctacagcaagttcgacgtgatcaacctggccgccgagaagacctacaacaacctggacgtgagcgtgaccaaggccctgcagcacagaagccactacttcgagggcgtgctgaagtgctacctgcacgagaccctggagaccatcatcaacagactggtggaggccgaggtgcacagactggtggtggtggacgagaacgacgtggtgaagggcatcgtgagcctgagcgacatcctgcaggccctggtgctgaccggcggcgagaagaagccctag

SEQ ID NO: 95156 - DNA, 1710 bp, Artificial Sequence
  Description of Artificial Sequence: Synthetic coding sequence
atgggcagcgccgtgatggacaccaagaagaagaaggacgtgagcagccccggcggcagcggcggcaagaagaacgccagccagaagagaagaagcctgagagtgcacatccccgacctgagcagcttcgccatgcccctgctggacggcgacctggagggcagcggcaagcacagcagcagaaaggtggacagccccttcggccccggcagccccagcaagggcttcttcagcagaggcccccagcccagacccagcagccccatgagcgcccccgtgagacccaagaccagccccggcagccccaagaccgtgttccccttcagctaccaggagagcccccccagaagccccagaagaatgagcttcagcggcatcttcagaagcagcagcaaggagagcagccccaacagcaaccccgccaccagccccggcggcatcagattcttcagcagaagcagaaagaccagcggcctgagcagcagccccagcacccccacccaggtgaccaagcagcacaccttccccctggagagctacaagcacgagcccgagagactggagaacagaatctacgccagcagcagcccccccgacaccggccagagattctgccccagcagcttccagagccccaccagaccccccctggccagccccacccactacgcccccagcaaggccgccgccctggccgccgccctgggccccgccgaggccggcatgctggagaagctggagttcgaggacgaggccgtggaggacagcgagagcggcgtgtacatgagattcatgagaagccacaagtgctacgacatcgtgcccaccagcagcaagctggtggtgttcgacaccaccctgcaggtgaagaaggccttcttcgccctggtggccaacggcgtgagagccgcccccctgtgggagagcaagaagcagagcttcgtgggcatgctgaccatcaccgacttcatcaacatcctgcacagatactacaagagccccatggtgcagatctacgagctggaggagcacaagatcgagacctggagagagctgtacctgcaggagaccttcaagcccctggtgaacatcagccccgacgccagcctgttcgacgccgtgtacagcctgatcaagaacaagatccacagactgcccgtgatcgaccccatcagcggcaacgccctgtacatcctgacccacaagagaatcctgaagttcctgcagctgttcatgagcgacatgcccaagcccgccttcatgaagcagaacctggacgagctgggcatcggcacctaccacaacatcgccttcatccaccccgacacccccatcatcaaggccctgaacatcttcgtggagagaagaatcagcgccctgcccgtggtggacgagagcggcaaggtggtggacatctacagcaagttcgacgtgatcaacctggccgccgagaagacctacaacaacctggacatcaccgtgacccaggccctgcagcacagaagccagtacttcgagggcgtggtgaagtgcaacaagctggagatcctggagaccatcgtggacagaatcgtgagagccgaggtgcacagactggtggtggtgaacgaggccgacagcatcgtgggcatcatcagcctgagcgacatcctgcaggccctgatcctgacccccgccggcgccaagcagaaggagaccgagaccgagtag

SEQ ID NO: 95157 - DNA, 1335 bp, Artificial Sequence
  Description of Artificial Sequence: Synthetic coding sequence
atgaagagattcggcagcctgagaagcaacaagaagcacaaggaccagaacagaagcaccgagagaagacagagcgagccccacggcctgttcgccagcggcctgagcagcagccccagcacccccacccaggtgaccaagcagcacaccttccccctggagagctacaagcacgagcccgagagactggagaacagaatctacgccagcagcagcccccccgacaccggccagagattctgccccagcagcttccagagccccaccagaccccccctggccagccccacccactacgcccccagcaaggccgccgccctggccgccgccctgggccccgccgaggccggcatgctggagaagctggagttcgaggacgaggtggaggacagcgagagcggcgtgtacatgagattcatgagaagccacaagtgctacgacatcgtgcccaccagcagcaagctggtggtgttcgacaccaccctgcaggtgaagaaggccttcttcgccctggtggccaacggcgtgagagccgcccccctgtgggagagcaagaagcagagcttcgtgggcatgctgaccatcaccgacttcatcaacatcctgcacagatactacaagagccccatggtgcagatctacgagctggaggagcacaagatcgagacctggagagagctgtacctgcaggagaccttcaagcccctggtgaacatcagccccgacgccagcctgttcgacgccgtgtacagcctgatcaagaacaagatccacagactgcccgtgatcgaccccatcagcggcaacgccctgtacatcctgacccacaagagaatcctgaagttcctgcagctgttcatgagcgacatgcccaagcccgccttcatgaagcagaacctggacgagctgggcatcggcacctaccacaacatcgccttcatccaccccgacacccccatcatcaaggccctgaacatcttcgtggagagaagaatcagcgccctgcccgtggtggacgagagcggcaaggtggtggacatctacagcaagttcgacgtgatcaacctggccgccgagaagacctacaacaacctggacatcaccgtgacccaggccctgcagcacagaagccagtacttcgagggcgtggtgaagtgcaacaagctggagatcctggagaccatcgtggacagaatcgtgagagccgaggtgcacagactggtggtggtgaacgaggccgacagcatcgtgggcatcatcagcctgagcgacatcctgcaggccctgatcctgacccccgccggcgccaagcagaaggagaccgagaccgagtag

SEQ ID NO: 95158 - DNA, 309 bp, Artificial Sequence
  Description of Artificial Sequence: Synthetic coding sequence
atggccggccaggccttcagaaagttcctgcccctgttcgacagagtgctggtggagagaagcgccgccgagaccgtgaccaagggcggcatcatgctgcccgagaagagccagggcaaggtgctgcaggccaccgtggtggccgtgggcagcggcagcaagggcaagggcggcgagatccagcccgtgagcgtgaaggtgggcgacaaggtgctgctgcccgagtacggcggcaccaaggtggtgctggacgacaaggactacttcctgttcagagacggcgacatcctgggcaagtacgtggactag

SEQ ID NO: 95159 - DNA, 1062 bp, Artificial Sequence
  Description of Artificial Sequence: Synthetic coding sequence
atggagcccggcctggagcacgccctgagaagaacccccagctggagcagcctgggcggcagcgagcaccaggagatgagcttcctggagcaggagaacagcagcagctggcccagccccgccgtgaccagcagcagcgagagaatcagaggcaagagaagagccaaggccctgagatggaccagacagaagagcgtggaggagggcgagccccccggccagggcgagggccccagaagcagacccgccgccgagagcaccggcctggaggccaccttccccaagaccacccccctggcccaggccgaccccgccggcgtgggcaccccccccaccggctgggactgcctgcccagcgactgcaccgccagcgccgccggcagcagcaccgacgacgtggagctggccaccgagttccccgccaccgaggcctgggagtgcgagctggagggcctgctggaggagagacccgccctgtgcctgagcccccaggcccccttccccaagctgggctgggacgacgagctgagaaagcccggcgcccagatctacatgagattcatgcaggagcacacctgctacgacgccatggccaccagcagcaagctggtgatcttcgacaccatgctggagatcaagaaggccttcttcgccctggtggccaacggcgtgagagccgcccccctgtgggacagcaagaagcagagcttcgtgggcatgctgaccatcaccgacttcatcctggtgctgcacagatactacagaagccccctgagaagcacctgcaaggccgccagcagcctgtggagccccagcctgctgatgatcgcctgcctgaagctgagcacccccagcagcagaaccggcagcatcgcctgcctgttcctgaccagatgccaggccacctacagcaccagcagccacaccaacgcctgcagcagcagctgcaccagcctggtgccctgctgccccggcccccccagcagcaccgccctgagcaagatctgggccagcgcccacagcgagacctggctgtggtgctggagacagcaccccagctag

SEQ ID NO: 95160 - DNA, 1395 bp, Artificial Sequence
  Description of Artificial Sequence: Synthetic coding sequence
atgagcttcctggagcaggagaacagcagcagctggcccagccccgccgtgaccagcagcagcgagagaatcagaggcaagagaagagccaaggccctgagatggaccagacagaagagcgtggaggagggcgagccccccggccagggcgagggccccagaagcagacccgccgccgagagcaccggcctggaggccaccttccccaagaccacccccctggcccaggccgaccccgccggcgtgggcaccccccccaccggctgggactgcctgcccagcgactgcaccgccagcgccgccggcagcagcaccgacgacgtggagctggccaccgagttccccgccaccgaggcctgggagtgcgagctggagggcctgctggaggagagacccgccctgtgcctgagcccccaggcccccttccccaagctgggctgggacgacgagctgagaaagcccggcgcccagatctacatgagattcatgcaggagcacacctgctacgacgccatggccaccagcagcaagctggtgatcttcgacaccatgctggagatcaagaaggccttcttcgccctggtggccaacggcgtgagagccgcccccctgtgggacagcaagaagcagagcttcgtgggcatgctgaccatcaccgacttcatcctggtgctgcacagatactacagaagccccctggtgcagatctacgagatcgagcagcacaagatcgagacctggagagagatctacctgcagggctgcttcaagcccctggtgagcatcagccccaacgacagcctgttcgaggccgtgtacaccctgatcaagaacagaatccacagactgcccgtgctggaccccgtgagcggcaacgtgctgcacatcctgacccacaagagactgctgaagttcctgcacatcttcggcagcctgctgcccagacccagcttcctgtacagaaccatccaggacctgggcatcggcaccttcagagacctggccgtggtgctggagaccgcccccatcctgaccgccctggacatcttcgtggacagaagagtgagcgccctgcccgtggtgaacgagtgcggccaggtggtgggcctgtacagcagattcgacgtgatccacctggccgcccagcagacctacaaccacctggacatgagcgtgggcgaggccctgagacagagaaccctgtgcctggagggcgtgctgagctgccagccccacgagagcctgggcgaggtgatcgacagaatcgccagagagcaggtgcacagactggtgctggtggacgagacccagcacctgctgggcgtggtgagcctgagcgacatcctgcaggccctggtgctgagccccgccggcatcgacgccctgggcgcctag

SEQ ID NO: 95161 - DNA, 1470 bp, Artificial Sequence
  Description of Artificial Sequence: Synthetic coding sequence
atggagcccggcctggagcacgccctgagaagaacccccagctggagcagcctgggcggcagcgagcaccaggagatgagcttcctggagcaggagaacagcagcagctggcccagccccgccgtgaccagcagcagcgagagaatcagaggcaagagaagagccaaggccctgagatggaccagacagaagagcgtggaggagggcgagccccccggccagggcgagggccccagaagcagacccgccgccgagagcaccggcctggaggccaccttccccaagaccacccccctggcccaggccgaccccgccggcgtgggcaccccccccaccggctgggactgcctgcccagcgactgcaccgccagcgccgccggcagcagcaccgacgacgtggagctggccaccgagttccccgccaccgaggcctgggagtgcgagctggagggcctgctggaggagagacccgccctgtgcctgagcccccaggcccccttccccaagctgggctgggacgacgagctgagaaagcccggcgcccagatctacatgagattcatgcaggagcacacctgctacgacgccatggccaccagcagcaagctggtgatcttcgacaccatgctggagatcaagaaggccttcttcgccctggtggccaacggcgtgagagccgcccccctgtgggacagcaagaagcagagcttcgtgggcatgctgaccatcaccgacttcatcctggtgctgcacagatactacagaagccccctggtgcagatctacgagatcgagcagcacaagatcgagacctggagagagatctacctgcagggctgcttcaagcccctggtgagcatcagccccaacgacagcctgttcgaggccgtgtacaccctgatcaagaacagaatccacagactgcccgtgctggaccccgtgagcggcaacgtgctgcacatcctgacccacaagagactgctgaagttcctgcacatcttcggcagcctgctgcccagacccagcttcctgtacagaaccatccaggacctgggcatcggcaccttcagagacctggccgtggtgctggagaccgcccccatcctgaccgccctggacatcttcgtggacagaagagtgagcgccctgcccgtggtgaacgagtgcggccaggtggtgggcctgtacagcagattcgacgtgatccacctggccgcccagcagacctacaaccacctggacatgagcgtgggcgaggccctgagacagagaaccctgtgcctggagggcgtgctgagctgccagccccacgagagcctgggcgaggtgatcgacagaatcgccagagagcaggtgcacagactggtgctggtggacgagacccagcacctgctgggcgtggtgagcctgagcgacatcctgcaggccctggtgctgagccccgccggcatcgacgccctgggcgcctag

SEQ ID NO: 95162 - DNA, 918 bp, Artificial Sequence
  Description of Artificial Sequence: Synthetic coding sequence
atgagattcatgcaggagcacacctgctacgacgccatggccaccagcagcaagctggtgatcttcgacaccatgctggagatcaagaaggccttcttcgccctggtggccaacggcgtgagagccgcccccctgtgggacagcaagaagcagagcttcgtgggcatgctgaccatcaccgacttcatcctggtgctgcacagatactacagaagccccctggtgcagatctacgagatcgagcagcacaagatcgagacctggagagagatctacctgcagggctgcttcaagcccctggtgagcatcagccccaacgacagcctgttcgaggccgtgtacaccctgatcaagaacagaatccacagactgcccgtgctggaccccgtgagcggcaacgtgctgcacatcctgacccacaagagactgctgaagttcctgcacatcttcggcagcctgctgcccagacccagcttcctgtacagaaccatccaggacctgggcatcggcaccttcagagacctggccgtggtgctggagaccgcccccatcctgaccgccctggacatcttcgtggacagaagagtgagcgccctgcccgtggtgaacgagtgcggccaggtggtgggcctgtacagcagattcgacgtgatccacctggccgcccagcagacctacaaccacctggacatgagcgtgggcgaggccctgagacagagaaccctgtgcctggagggcgtgctgagctgccagccccacgagagcctgggcgaggtgatcgacagaatcgccagagagcaggtgcacagactggtgctggtggacgagacccagcacctgctgggcgtggtgagcctgagcgacatcctgcaggccctggtgctgagccccgccggcatcgacgccctgggcgcctag

SEQ ID NO: 95163 - DNA, 1056 bp, Artificial Sequence
  Description of Artificial Sequence: Synthetic coding sequence
atgggcaacgccgccgccgccaagaagggcagcgagcaggagagcgtgaaggagttcctggccaaggccaaggaggacttcctgaagaagtgggagagccccgcccagaacaccgcccacctggaccagttcgagagaatcaagaccctgggcaccggcagcttcggcagagtgatgctggtgaagcacaaggagaccggcaaccactacgccatgaagatcctggacaagcagaaggtggtgaagctgaagcagatcgagcacaccctgaacgagaagagaatcctgcaggccgtgaacttccccttcctggtgaagctggagttcagcttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccagcagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgaacgacatcaagaaccacaagtggttcgccaccaccgactggatcgccatctaccagagaaaggtggaggcccccttcatccccaagttcaagggccccggcgacaccagcaacttcgacgactacgaggaggaggagatcagagtgagcatcaacgagaagtgcggcaaggagttcagcgagttctag

SEQ ID NO: 95164 - DNA, 1032 bp, Artificial Sequence; identical to SEQ ID NO: 95133
  Description of Artificial Sequence: Synthetic coding sequence

SEQ ID NO: 95165 - DNA, 1056 bp, Artificial Sequence; identical to SEQ ID NO: 95163
  Description of Artificial Sequence: Synthetic coding sequence

SEQ ID NO: 95166 - DNA, 693 bp, Artificial Sequence
  Description of Artificial Sequence: Synthetic coding sequence
atgctggtgaagcacaaggagaccggcaaccactacgccatgaagatcctggacaagcagaaggtggtgaagctgaagcagatcgagcacaccctgaacgagaagagaatcctgcaggccgtgaacttccccttcctggtgaagctggagttcagcttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccagcagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagaagcggctgcggcgacaccgccctggaggagaccgacagaagcctgctgacccaccccatcccctggggcgccctgctggtggtgagaatcatctag

SEQ ID NO: 95167 - DNA, 1074 bp, Artificial Sequence
  Description of Artificial Sequence: Synthetic coding sequence
atgggcctgagcagaaagagcagcgacgccagcgcctgcagcagcagcgagatcagcgacttcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95168 - DNA, 795 bp, Artificial Sequence
  Description of Artificial Sequence: Synthetic coding sequence
atgagcgccagaaagagcagcgacgccagcgcctgcagcagcagcgagatcagcgacagcttcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaagcagaacttctag

SEQ ID NO: 95169 - DNA, 942 bp, Artificial Sequence
  Description of Artificial Sequence: Synthetic coding sequence
atgcccgacctgaagatcctgaagggcaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95170 - DNA, 1068 bp, Artificial Sequence
  Description of Artificial Sequence: Synthetic coding sequence
atgggcctgagcagaaagagcagcgacgccagcgcctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95171 - DNA, 738 bp, Artificial Sequence
  Description of Artificial Sequence: Synthetic coding sequence
atgggcctgctgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaagaacttctag

SEQ ID NO: 95172 - DNA, 1197 bp, Artificial Sequence
  Description of Artificial Sequence: Synthetic coding sequence
atggccgcctacagagagcccccctgcaaccagtacaccggcaccaccaccgccctgcagaagctggagggcttcgccagcagactgttccacagacacagcaagggcaccgcccacgaccagaagaccgccctggagaacgacagcctgcacttcagcgagcacaccgccctgtgggacagaagcatgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95173 - DNA, 774 bp, Artificial Sequence
  Description of Artificial Sequence: Synthetic coding sequence
atgggcaacgccgccaccgccaagaagggcagcgaggtggagagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaagaacttctag

SEQ ID NO: 95174 - DNA, 1056 bp, Artificial Sequence
  Description of Artificial Sequence: Synthetic coding sequence
atgggcaacgccgccaccgccaagaagggcagcgaggtggagagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95175 - DNA, 1077 bp, Artificial Sequence
  Description of Artificial Sequence: Synthetic coding sequence
atgggcctgagcagaaagagcagcgacgccagcgcctgcagcagcagcgagatcagcgacagcttcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95176 - DNA, 966 bp, Artificial Sequence
  Description of Artificial Sequence: Synthetic coding sequence
atgagcgccagaaagagcagcgacgccagcgcctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgccggctacccccccttcttcgccgaccagcccatccagatctacgagaagatcgtgagcggcaaggtgagattccccagccacttcagcagcgacctgaaggacctgctgagaaacctgctgcaggtggacctgaccaagagattcggcaacctgaagaacggcgtgagcgacatcaagacccacaagtggttcgccaccaccgactggatcgccatctaccagagaaaggtggaggcccccttcatccccaagttcagaggcagcggcgacaccagcaacttcgacgactacgaggaggaggacatcagagtgagcatcaccgagaagtgcgccaaggagttcggcgagttctag

SEQ ID NO: 95177 - DNA, 630 bp, Artificial Sequence
  Description of Artificial Sequence: Synthetic coding sequence
atgagcgcctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagtag

SEQ ID NO: 95178 - DNA, 594 bp, Artificial Sequence
  Description of Artificial Sequence: Synthetic coding sequence
atgagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatctag

SEQ ID NO: 95179 - DNA, 645 bp, Artificial Sequence
  Description of Artificial Sequence: Synthetic coding sequence
atgggcctgagctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcacccccgagtacctggcccccgagatcatcctgagcaagggctacaacaagtag

SEQ ID NO: 95180 - DNA, 561 bp, Artificial Sequence
  Description of Artificial Sequence: Synthetic coding sequence
atgggcctgagcagaaagagcagcgacgccagcgcctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccagtag

SEQ ID NO: 95181 - DNA, 528 bp, Artificial Sequence
  Description of Artificial Sequence: Synthetic coding sequence
atgggcctgagcagaaagagcagcgacgccagcgcctgcagcagcagcgagatcagcgacagcttcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgtag

SEQ ID NO: 95182 - DNA, 621 bp, Artificial Sequence
  Description of Artificial Sequence: Synthetic coding sequence
atgagcgccagaaagagcagcgacgccagcgcctgcagcagcagcgagatcagcgtgaaggagttcctggccaaggccaaggaggacttcctgaagaagtgggagaaccccacccagaacaacgccggcctggaggacttcgagagaaagaagaccctgggcaccggcagcttcggcagagtgatgctggtgaagcacaaggccaccgagcagtactacgccatgaagatcctggacaagcagaaggtggtgaagctgaagcagatcgagcacaccctgaacgagaagagaatcctgcaggccgtgaacttccccttcctggtgagactggagtacgccttcaaggacaacagcaacctgtacatggtgatggagtacgtgcccggcggcgagatgttcagccacctgagaagaatcggcagattcagcgagccccacgccagattctacgccgcccagatcgtgctgaccttcgagtacctgcacagcctggacctgatctacagagacctgaagcccgagaacctgctgatcgaccaccagggctacatccaggtgaccgacttcggcttcgccaagagagtgaagggcagaacctggaccctgtgcggcaccccctag

SEQ ID NO: 95183 - DNA, 1056 bp, Artificial Sequence
  Description of Artificial Sequence: Synthetic coding sequence
atgggcaacgcccccgccaagaaggacaccgagcaggaggagagcgtgaacgagttcctggccaaggccagaggcgacttcctgtacagatggggcaaccccgcccagaacaccgccagcagcgaccagttcgagagactgagaaccctgggcatgggcagcttcggcagagtgatgctggtgagacaccaggagaccggcggccactacgccatgaagatcctgaacaagcagaaggtggtgaagatgaagcaggtggagcacatcctgaacgagaagagaatcctgcaggccatcgacttccccttcctggtgaagctgcagttcagcttcaaggacaacagctacctgtacctggtgatggagtacgtgcccggcggcgagatgttcagcagactgcagagagtgggcagattcagcgagccccacgcctgcttctacgccgcccaggtggtgctggccgtgcagtacctgcacagcctggacctgatccacagagacctgaagcccgagaacctgctgatcgaccagcagggctacctgcaggtgaccgacttcggcttcgccaagagagtgaagggcagaacctggaccctgtgcggcacccccgagtacctggcccccgagatcatcctgagcaagggctacaacaaggccgtggactggtgggccctgggcgtgctgatctacgagatggccgtgggcttcccccccttctacgccgaccagcccatccagatctacgagaagatcgtgagcggcagagtgagattccccagcaagctgagcagcgacctgaagcacctgctgagaagcctgctgcaggtggacctgaccaagagattcggcaacctgagaaacggcgtgggcgacatcaagaaccacaagtggttcgccaccaccagctggatcgccatctacgagaagaaggtggaggcccccttcatccccaagtacaccggccccggcgacgccagcaacttcgacgactacgaggaggaggagctgagaatcagcatcaacgagaagtgcgccaaggagttcagcgagttctag

SEQ ID NO: 95184 - DNA, 1146 bp, Artificial Sequence; identical to SEQ ID NO: 95134
  Description of Artificial Sequence: Synthetic coding sequence

SEQ ID NO: 95185 - DNA, 1146 bp, Artificial Sequence; identical to SEQ ID NO: 95134
  Description of Artificial Sequence: Synthetic coding sequence

SEQ ID NO: 95186 - DNA, 1146 bp, Artificial Sequence; identical to SEQ ID NO: 95134
  Description of Artificial Sequence: Synthetic coding sequence

SEQ ID NO: 95187 - DNA, 1146 bp, Artificial Sequence; identical to SEQ ID NO: 95134
  Description of Artificial Sequence: Synthetic coding sequence

SEQ ID NO: 95188 - DNA, 243 bp, Artificial Sequence
  Description of Artificial Sequence: Synthetic coding sequence
atgggcagcaccctgagaaagagaaagatgtacgaggagttcctgagcaaggtgagcatcctggagagcctggagaagtgggagagactgaccgtggccgacgccctggagcccgtgcagttcgaggacggcgagaagatcgtggtgcagggcgagcccggcgacgacttctacatcatcaccgagaagaacctgcccggcgtggtggcccacgcctgcaaccccagctacctgggcggctag

SEQ ID NO: 95189 - DNA, 1146 bp, Artificial Sequence
  Description of Artificial Sequence: Synthetic coding sequence
atggccagcccccccgcctgccccagcgaggaggacgagagcctgaagggctgcgagctgtacgtgcagctgcacggcatccagcaggtgctgaaggactgcatcgtgcacctgtgcatcagcaagcccgagagacccatgaagttcctgagagagcacttcgagaagctggagaaggaggagaacagacagatcctggccagacagaagagcaacagccagagcgacagccacgacgaggaggtgagccccaccccccccaaccccgtggtgaaggccagaagaagaagaggcggcgtgagcgccgaggtgtacaccgaggaggacgccgtgagctacgtgagaaaggtgatccccaaggactacaagaccatgaccgccctggccaaggccatcagcaagaacgtgctgttcgcccacctggacgacaacgagagaagcgacatcttcgacgccatgttccccgtgacccacatcgccggcgagaccgtgatccagcagggcaacgagggcgacaacttctacgtggtggaccagggcgaggtggacgtgtacgtgaacggcgagtgggtgaccaacatcagcgagggcggcagcttcggcgagctggccctgatctacggcacccccagagccgccaccgtgaaggccaagaccgacctgaagctgtggggcatcgacagagacagctacagaagaatcctgatgggcagcaccctgagaaagagaaagatgtacgaggagttcctgagcaaggtgagcatcctggagagcctggagaagtgggagagactgaccgtggccgacgccctggagcccgtgcagttcgaggacggcgagaagatcgtggtgcagggcgagcccggcgacgacttctacatcatcaccgagggcaccgccagcgtgctgcagagaagaagccccaacgaggagtacgtggaggtgggcagactgggccccagcgactacttcggcgagatcgccctgctgctgaacagacccagagccgccaccgtggtggccagaggccccctgaagtgcgtgaagctggacagacccagattcgagagagtgctgggcccctgcagcgagatcctgaagagaaacatccagagatacaacagcttcatcagcctgaccgtgtag

SEQ ID NO: 95190 - DNA, 1146 bp, Artificial Sequence; identical to SEQ ID NO: 95189
  Description of Artificial Sequence: Synthetic coding sequence

SEQ ID NO: 95191 - DNA, 1146 bp, Artificial Sequence; identical to SEQ ID NO: 95189
  Description of Artificial Sequence: Synthetic coding sequence

SEQ ID NO: 95192 - DNA, 498 bp, Artificial Sequence
  Description of Artificial Sequence: Synthetic coding sequence
atggccagcccccccgcctgccccagcgaggaggacgagagcctgaagggctgcgagctgtacgtgcagctgcacggcatccagcaggtgctgaaggactgcatcgtgcacctgtgcatcagcaagcccgagagacccatgaagttcctgagagagcacttcgagaagctggagaaggaggagaacagacagatcctggccagacagaagagcaacagccagagcgacagccacgacgaggaggtgagccccaccccccccaaccccgtggtgaaggccagaagaagaagaggcggcgtgagcgccgaggtgtacaccgaggaggacgccgtgagctacgtgagaaaggtgatccccaaggactacaagaccatgaccgccctggccaaggccatcagcaagaacgtgctgttcgcccacctggacgacaacgagagaagcgacatcttcgacgccatgttccccgtgacccacatcgccggcgagaccgtgatctag

SEQ ID NO: 95193 - DNA, 894 bp, Artificial Sequence
  Description of Artificial Sequence: Synthetic coding sequence
atggccagcccccccgcctgccccagcgaggaggacgagagcctgaagggctgcgagctgtacgtgcagctgcacggcatccagcaggtgctgaaggactgcatcgtgcacctgtgcatcagcaagcccgagagacccatgaagttcctgagagagcacttcgagaagctggagaaggaggagaacagacagatcctggccagacagaagagcaacagccagagcgacagccacgacgaggaggtgagccccaccccccccaaccccgtggtgaaggccagaagaagaagaggcggcgtgagcgccgaggtgtacaccgaggaggacgccgtgagctacgtgagaaaggtgatccccaaggactacaagaccatgaccgccctggccaaggccatcagcaagaacgtgctgttcgcccacctggacgacaacgagagaagcgacatcttcgacgccatgttccccgtgacccacatcgccggcgagaccgtgatccagcagggcaacgagggcgacaacttctacgtggtggaccagggcgaggtggacgtgtacgtgaacggcgagtgggtgaccaacatcagcgagggcggcagcttcggcgagctggccctgatctacggcacccccagagccgccaccgtgaaggccaagaccgacctgaagctgtggggcatcgacagagacagctacagaagaatcctgatgggcagcaccctgagaaagagaaagatgtacgaggagttcctgagcaaggtgagcatcctggagagcctggagaagtgggagagactgaccgtggccgacgccctggagcccgtgcagttcgaggacggcgagaagatcgtggtgcagggcgagcccggcgacgacttctacatcatcaccgagtag

SEQ ID NO: 95194 - DNA, 177 bp, Artificial Sequence
  Description of Artificial Sequence: Synthetic coding sequence
atggccagcccccccgcctgccccagcgaggaggacgagagcctgaagggctgcgagctgtacgtgcagctgcacggcatccagcaggtgctgaaggactgcatcgtgcacctgtgcatcagcaagcccgagagacccatgaagttcctgagagagcacttcgagaagctggagtag

SEQ ID NO: 95195 - DNA, 1146 bp, Artificial Sequence; identical to SEQ ID NO: 95189
  Description of Artificial Sequence: Synthetic coding sequence

SEQ ID NO: 95196 - DNA, 1146 bp, Artificial Sequence; identical to SEQ ID NO: 95189
  Description of Artificial Sequence: Synthetic coding sequence

SEQ ID NO: 95197 - DNA, 1215 bp, Artificial Sequence
  Description of Artificial Sequence: Synthetic coding sequence
atgagccacatccagatcccccccggcctgaccgagctgctgcagggctacaccgtggaggtgctgagacagcagccccccgacctggtggagttcgccgtggagtacttcaccagactgagagaggccagagcccccgccagcgtgctgcccgccgccacccccagacagagcctgggccaccccccccccgagcccggccccgacagagtggccgacgccaagggcgacagcgagagcgaggaggacgaggacctggaggtgcccgtgcccagcagattcaacagaagagtgagcgtgtgcgccgagacctacaaccccgacgaggaggaggaggacaccgaccccagagtgatccaccccaagaccgacgagcagagatgcagactgcaggaggcctgcaaggacatcctgctgttcaagaacctggaccaggagcagctgagccaggtgctggacgccatgttcgagagaatcgtgaaggccgacgagcacgtgatcgaccagggcgacgacggcgacaacttctacgtgatcgagagaggcacctacgacatcctggtgaccaaggacaaccagaccagaagcgtgggccagtacgacaacagaggcagcttcggcgagctggccctgatgtacaacacccccagagccgccaccatcgtggccaccagcgagggcagcctgtggggcctggacagagtgaccttcagaagaatcatcgtgaagaacaacgccaagaagagaaagatgttcgagagcttcatcgagagcgtgcccctgctgaagagcctggaggtgagcgagagaatgaagatcgtggacgtgatcggcgagaagatctacaaggacggcgagagaatcatcacccagggcgagaaggccgacagcttctacatcatcgagagcggcgaggtgagcatcctgatcagaagcagaaccaagagcaacaaggacggcggcaaccaggaggtggagatcgccagatgccacaagggccagtacttcggcgagctggccctggtgaccaacaagcccagagccgccagcgcctacgccgtgggcgacgtgaagtgcctggtgatggacgtgcaggccttcgagagactgctgggcccctgcatggacatcatgaagagaaacatcagccactacgaggagcagctggtgaagatgttcggcagcagcgtggacctgggcaacctgggccagtag

SEQ ID NO: 95198 - DNA, 1149 bp, Artificial Sequence
  Description of Artificial Sequence: Synthetic coding sequence
atgagccacatccagatcccccccggcctgaccgagctgctgcagggctacaccgtggaggtgctgagacagcagccccccgacctggtggagttcgccgtggagtacttcaccagactgagagaggccagagcccccgccagcgtgctgcccgccgccacccccagacagagcctgggccaccccccccccgagcccggccccgacagagtggccgacgccaagggcgacagcgagagcgaggaggacgaggacctggaggtgcccgtgcccagcagattcaacagaagagtgagcgtgtgcgccgagacctacaaccccgacgaggaggaggaggacaccgaccccagagtgatccaccccaagaccgacgagcagagatgcagactgcaggaggcctgcaaggacatcctgctgttcaagaacctggaccaggagcagctgagccaggtgctggacgccatgttcgagagaatcgtgaaggccgacgagcacgtgatcgaccagggcgacgacggcgacaacttctacgtgatcgagagaggcacctacgacatcctggtgaccaaggacaaccagaccagaagcgtgggccagtacgacaacagaggcagcttcggcgagctggccctgatgtacaacacccccagagccgccaccatcgtggccaccagcgagggcagcctgtggggcctggacagagtgaccttcagaagaatcatcgtgaagaacaacgccaagaagagaaagatgttcgagagcttcatcgagagcgtgcccctgctgaagagcctggaggtgagcgagagaatgaagatcgtggacgtgatcggcgagaagatctacaaggacggcgagagaatcatcacccagaccaagagcaacaaggacggcggcaaccaggaggtggagatcgccagatgccacaagggccagtacttcggcgagctggccctggtgaccaacaagcccagagccgccagcgcctacgccgtgggcgacgtgaagtgcctggtgatggacgtgcaggccttcgagagactgctgggcccctgcatggacatcatgaagagaaacatcagccactacgaggagcagctggtgaagatgttcggcagcagcgtggacctgggcaacctgggccagtag

SEQ ID NO: 95199 - DNA, 1215 bp, Artificial Sequence; identical to SEQ ID NO: 95197
  Description of Artificial Sequence: Synthetic coding sequence

SEQ ID NO: 95200 - DNA, 1257 bp, Artificial Sequence
  Description of Artificial Sequence: Synthetic coding sequence
atgagcatcgagatccccgccggcctgaccgagctgctgcagggcttcaccgtggaggtgctgagacaccagcccgccgacctgctggagttcgccctgcagcacttcaccagactgcagcaggagaacgagagaaagggcaccgccagattcggccacgagggcagaacctggggcgacctgggcgccgccgccggcggcggcacccccagcaagggcgtgaacttcgccgaggagcccatgcagagcgacagcgaggacggcgaggaggaggaggccgcccccgccgacgccggcgccttcaacgcccccgtgatcaacagattcaccagaagagccagcgtgtgcgccgaggcctacaaccccgacgaggaggaggacgacgccgagagcagaatcatccaccccaagaccgacgaccagagaaacagactgcaggaggcctgcaaggacatcctgctgttcaagaacctggaccccgagcagatgagccaggtgctggacgccatgttcgagaagctggtgaaggacggcgagcacgtgatcgaccagggcgacgacggcgacaacttctacgtgatcgacagaggcaccttcgacatctacgtgaagtgcgacggcgtgggcagatgcgtgggcaactacgacaacagaggcagcttcggcgagctggccctgatgtacaacacccccagagccgccaccatcaccgccaccagccccggcgccctgtggggcctggacagagtgaccttcagaagaatcatcgtgaagaacaacgccaagaagagaaagatgtacgagagcttcatcgagagcctgcccttcctgaagagcctggagttcagcgagagactgaaggtggtggacgtgatcggcaccaaggtgtacaacgacggcgagcagatcatcgcccagggcgacagcgccgacagcttcttcatcgtggagagcggcgaggtgaagatcaccatgaagagaaagggcaagagcgaggtggaggagaacggcgccgtggagatcgccagatgcagcagaggccagtacttcggcgagctggccctggtgaccaacaagcccagagccgccagcgcccacgccatcggcaccgtgaagtgcctggccatggacgtgcaggccttcgagagactgctgggcccctgcatggagatcatgaagagaaacatcgccacctacgaggagcagctggtggccctgttcggcaccaacatggacatcgtggagcccaccgcctag

SEQ ID NO: 95201 - DNA, 1218 bp, Artificial Sequence
  Description of Artificial Sequence: Synthetic coding sequence
atgagcatcgagatccccgccggcctgaccgagctgctgcagggcttcaccgtggaggtgctgagacaccagcccgccgacctgctggagttcgccctgcagcacttcaccagactgcagcaggagaacgagagaaagggcaccgccagattcggccacgagggcagaacctggggcgacctgggcgccgccgccggcggcggcacccccagcaagggcgtgaacttcgccgaggaggccgcccccgccgacgccggcgccttcaacgcccccgtgatcaacagattcaccagaagagccagcgtgtgcgccgaggcctacaaccccgacgaggaggaggacgacgccgagagcagaatcatccaccccaagaccgacgaccagagaaacagactgcaggaggcctgcaaggacatcctgctgttcaagaacctggaccccgagcagatgagccaggtgctggacgccatgttcgagaagctggtgaaggacggcgagcacgtgatcgaccagggcgacgacggcgacaacttctacgtgatcgacagaggcaccttcgacatctacgtgaagtgcgacggcgtgggcagatgcgtgggcaactacgacaacagaggcagcttcggcgagctggccctgatgtacaacacccccagagccgccaccatcaccgccaccagccccggcgccctgtggggcctggacagagtgaccttcagaagaatcatcgtgaagaacaacgccaagaagagaaagatgtacgagagcttcatcgagagcctgcccttcctgaagagcctggagttcagcgagagactgaaggtggtggacgtgatcggcaccaaggtgtacaacgacggcgagcagatcatcgcccagggcgacagcgccgacagcttcttcatcgtggagagcggcgaggtgaagatcaccatgaagagaaagggcaagagcgaggtggaggagaacggcgccgtggagatcgccagatgcagcagaggccagtacttcggcgagctggccctggtgaccaacaagcccagagccgccagcgcccacgccatcggcaccgtgaagtgcctggccatggacgtgcaggccttcgagagactgctgggcccctgcatggagatcatgaagagaaacatcgccacctacgaggagcagctggtggccctgttcggcaccaacatggacatcgtggagcccaccgcctag

SEQ ID NO: 95202 - DNA, 1257 bp, Artificial Sequence; identical to SEQ ID NO: 95200
  Description of Artificial Sequence: Synthetic coding sequence

SEQ ID NO: 95203 - DNA, 1170 bp, Artificial Sequence
  Description of Artificial Sequence: Synthetic coding sequence
atggagaagcagaacatgttcctgcacggcagctacatcctgagagaggacgtgagaaccgccaacgtgatcgccgccgaggccgtgacctgcctggtgatcgacagagacagcttcaagcacctgatcggcggcctggacgacgtgagcaacaaggcctacgaggacgccgaggccaaggccaagtacgaggccgaggccgccttcttcgccaacctgaagctgagcgacttcaacatcatcgacaccctgggcgtgggcggcttcggcagagtggagctggtgcagctgaagagcgaggagagcaagaccttcgccatgaagatcctgaagaagagacacatcgtggacaccagacagcaggagcacatcagaagcgagaagcagatcatgcagggcgcccacagcgacttcatcgtgagactgtacagaaccttcaaggacagcaagtacctgtacatgctgatggaggcctgcctgggcggcgagctgtggaccatcctgagagacagaggcagcttcgaggacagcaccaccagattctacaccgcctgcgtggtggaggccttcgcctacctgcacagcaagggcatcatctacagagacctgaagcccgagaacctgatcctggaccacagaggctacgccaagctggtggacttcggcttcgccaagaagatcggcttcggcaagaagacctggaccttctgcggcacccccgagtacgtggcccccgagatcatcctgaacaagggccacgacatcagcgccgactactggagcctgggcatcctgatgtacgagctgctgaccggcagcccccccttcagcggccccgaccccatgaagacctacaacatcatcctgagaggcatcgacatgatcgagttccccaagaagatcgccaagaacgccgccaacctgatcaagaagctgtgcagagacaaccccagcgagagactgggcaacctgaagaacggcgtgaaggacatccagaagcacaagtggttcgagggcttcaactgggagggcctgagaaagggcaccctgaccccccccatcatccccagcgtggccagccccaccgacaccagcaacttcgacagcttccccgaggacaacgacgagcccccccccgacgacaacagcggctgggacatcgacttctag

SEQ ID NO: 95204 - DNA, 852 bp, Artificial Sequence
  Description of Artificial Sequence: Synthetic coding sequence
atgaagatcctgaagaagagacacatcgtggacaccagacagcaggagcacatcagaagcgagaagcagatcatgcagggcgcccacagcgacttcatcgtgagactgtacagaaccttcaaggacagcaagtacctgtacatgctgatggaggcctgcctgggcggcgagctgtggaccatcctgagagacagaggcagcttcgaggacagcaccaccagattctacaccgcctgcgtggtggaggccttcgcctacctgcacagcaagggcatcatctacagagacctgaagcccgagaacctgatcctggaccacagaggctacgccaagctggtggacttcggcttcgccaagaagatcggcttcggcaagaagacctggaccttctgcggcacccccgagtacgtggcccccgagatcatcctgaacaagggccacgacatcagcgccgactactggagcctgggcatcctgatgtacgagctgctgaccggcagcccccccttcagcggccccgaccccatgaagacctacaacatcatcctgagaggcatcgacatgatcgagttccccaagaagatcgccaagaacgccgccaacctgatcaagaagctgtgcagagacaaccccagcgagagactgggcaacctgaagaacggcgtgaaggacatccagaagcacaagtggttcgagggcttcaactgggagggcctgagaaagggcaccctgaccccccccatcatccccagcgtggccagccccaccgacaccagcaacttcgacagcttccccgaggacaacgacgagcccccccccgacgacaacagcggctgggacatcgacttctag

SEQ ID NO: 95205 - DNA, 546 bp, Artificial Sequence
  Description of Artificial Sequence: Synthetic coding sequence
agctgcatcatcaaggagggcgacgtgggcagcctggtgtacgtgatggaggacggcaaggtggaggtgaccaaggagggcgtgaagctgtgcaccatgggccccggcaaggtgttcggcgagctggccatcctgtacaactgcaccagaaccgccaccgtgaagaccctggtgaacgtgaagctgtgggccatcgacagacagtgcttccagaccatcatgatgagaaccggcctgatcaagcacaccgagtacatggagttcctgaagagcgtgcccaccttccagagcctgcccgaggagatcctgagcaagctggccgacgtgctggaggagacccactacgagaacggcgagtacatcatcagacagggcgccagaggcgacaccttcttcatcatcagcaagggcaccgtgaacgtgaccagagaggacagccccagcgaggaccccgtgttcctgagaaccctgggcaagggcgactggttcggcgagaaggccctgcagggctggacctggaacctgttcgagtacgtggtggagtag

SEQ ID NO: 95206 - DNA, 2061 bp, Artificial Sequence
  Description of Artificial Sequence: Synthetic coding sequence
atgggcaccctgagagacctgcagtacgccctgcaggagaagatcgaggagctgagacagagagacgccctgatcgacgagctggagctggagctggaccagaaggacgagctgatccagaagctgcagaacgagctggacaagtacagaagcgtgatcagacccgccacccagcaggcccagaagcagagcgccagcaccctgcagggcgagcccagaaccaagagacaggccatcagcgccgagcccaccgccttcgacatccaggacctgagccacgtgaccctgcccttctaccccaagagcccccagagcaaggacctgatcaaggaggccatcctggacaacgacttcatgaagaacctggagctgagccagatccaggagatcgtggactgcatgtaccccgtggagtacggcaaggacagctgcatcatcaaggagggcgacgtgggcagcctggtgtacgtgatggaggacggcaaggtggaggtgaccaaggagggcgtgaagctgtgcaccatgggccccggcaaggtgttcggcgagctggccatcctgtacaactgcaccagaaccgccaccgtgaagaccctggtgaacgtgaagctgtgggccatcgacagacagtgcttccagaccatcatgatgagaaccggcctgatcaagcacaccgagtacatggagttcctgaagagcgtgcccaccttccagagcctgcccgaggagatcctgagcaagctggccgacgtgctggaggagacccactacgagaacggcgagtacatcatcagacagggcgccagaggcgacaccttcttcatcatcagcaagggcaccgtgaacgtgaccagagaggacagccccagcgaggaccccgtgttcctgagaaccctgggcaagggcgactggttcggcgagaaggccctgcagggcgaggacgtgagaaccgccaacgtgatcgccgccgaggccgtgacctgcctggtgatcgacagagacagcttcaagcacctgatcggcggcctggacgacgtgagcaacaaggcctacgaggacgccgaggccaaggccaagtacgaggccgaggccgccttcttcgccaacctgaagctgagcgacttcaacatcatcgacaccctgggcgtgggcggcttcggcagagtggagctggtgcagctgaagagcgaggagagcaagaccttcgccatgaagatcctgaagaagagacacatcgtggacaccagacagcaggagcacatcagaagcgagaagcagatcatgcagggcgcccacagcgacttcatcgtgagactgtacagaaccttcaaggacagcaagtacctgtacatgctgatggaggcctgcctgggcggcgagctgtggaccatcctgagagacagaggcagcttcgaggacagcaccaccagattctacaccgcctgcgtggtggaggccttcgcctacctgcacagcaagggcatcatctacagagacctgaagcccgagaacctgatcctggaccacagaggctacgccaagctggtggacttcggcttcgccaagaagatcggcttcggcaagaagacctggaccttctgcggcacccccgagtacgtggcccccgagatcatcctgaacaagggccacgacatcagcgccgactactggagcctgggcatcctgatgtacgagctgctgaccggcagcccccccttcagcggccccgaccccatgaagacctacaacatcatcctgagaggcatcgacatgatcgagttccccaagaagatcgccaagaacgccgccaacctgatcaagaagctgtgcagagacaaccccagcgagagactgggcaacctgaagaacggcgtgaaggacatccagaagcacaagtggttcgagggcttcaactgggagggcctgagaaagggcaccctgaccccccccatcatccccagcgtggccagccccaccgacaccagcaacttcgacagcttccccgaggacaacgacgagcccccccccgacgacaacagcggctgggacatcgacttctag

SEQ ID NO: 95207 - DNA, 1980 bp, Artificial Sequence
  Description of Artificial Sequence: Synthetic coding sequence
atgctgaaggaggagagaatcaaggagctggagaagagactgagcgagaaggaggaggagatccaggagctgaagagaaagctgcacaagtgccagagcgtgctgcccgtgcccagcacccacatcggccccagaaccaccagagcccagggcatcagcgccgagccccagacctacagaagcttccacgacctgagacaggccttcagaaagttcaccaagagcgagagaagcaaggacctgatcaaggaggccatcctggacaacgacttcatgaagaacctggagctgagccagatccaggagatcgtggactgcatgtaccccgtggagtacggcaaggacagctgcatcatcaaggagggcgacgtgggcagcctggtgtacgtgatggaggacggcaaggtggaggtgaccaaggagggcgtgaagctgtgcaccatgggccccggcaaggtgttcggcgagctggccatcctgtacaactgcaccagaaccgccaccgtgaagaccctggtgaacgtgaagctgtgggccatcgacagacagtgcttccagaccatcatgatgagaaccggcctgatcaagcacaccgagtacatggagttcctgaagagcgtgcccaccttccagagcctgcccgaggagatcctgagcaagctggccgacgtgctggaggagacccactacgagaacggcgagtacatcatcagacagggcgccagaggcgacaccttcttcatcatcagcaagggcaccgtgaacgtgaccagagaggacagccccagcgaggaccccgtgttcctgagaaccctgggcaagggcgactggttcggcgagaaggccctgcagggcgaggacgtgagaaccgccaacgtgatcgccgccgaggccgtgacctgcctggtgatcgacagagacagcttcaagcacctgatcggcggcctggacgacgtgagcaacaaggcctacgaggacgccgaggccaaggccaagtacgaggccgaggccgccttcttcgccaacctgaagctgagcgacttcaacatcatcgacaccctgggcgtgggcggcttcggcagagtggagctggtgcagctgaagagcgaggagagcaagaccttcgccatgaagatcctgaagaagagacacatcgtggacaccagacagcaggagcacatcagaagcgagaagcagatcatgcagggcgcccacagcgacttcatcgtgagactgtacagaaccttcaaggacagcaagtacctgtacatgctgatggaggcctgcctgggcggcgagctgtggaccatcctgagagacagaggcagcttcgaggacagcaccaccagattctacaccgcctgcgtggtggaggccttcgcctacctgcacagcaagggcatcatctacagagacctgaagcccgagaacctgatcctggaccacagaggctacgccaagctggtggacttcggcttcgccaagaagatcggcttcggcaagaagacctggaccttctgcggcacccccgagtacgtggcccccgagatcatcctgaacaagggccacgacatcagcgccgactactggagcctgggcatcctgatgtacgagctgctgaccggcagcccccccttcagcggccccgaccccatgaagacctacaacatcatcctgagaggcatcgacatgatcgagttccccaagaagatcgccaagaacgccgccaacctgatcaagaagctgtgcagagacaaccccagcgagagactgggcaacctgaagaacggcgtgaaggacatccagaagcacaagtggttcgagggcttcaactgggagggcctgagaaagggcaccctgaccccccccatcatccccagcgtggccagccccaccgacaccagcaacttcgacagcttccccgaggacaacgacgagcccccccccgacgacaacagcggctgggacatcgacttctag

SEQ ID NO: 95208 - DNA, 2016 bp, Artificial Sequence
  Description of Artificial Sequence: Synthetic coding sequence
atgagcgagctggaggaggacttcgccaagatcctgatgctgaaggaggagagaatcaaggagctggagaagagactgagcgagaaggaggaggagatccaggagctgaagagaaagctgcacaagtgccagagcgtgctgcccgtgcccagcacccacatcggccccagaaccaccagagcccagggcatcagcgccgagccccagacctacagaagcttccacgacctgagacaggccttcagaaagttcaccaagagcgagagaagcaaggacctgatcaaggaggccatcctggacaacgacttcatgaagaacctggagctgagccagatccaggagatcgtggactgcatgtaccccgtggagtacggcaaggacagctgcatcatcaaggagggcgacgtgggcagcctggtgtacgtgatggaggacggcaaggtggaggtgaccaaggagggcgtgaagctgtgcaccatgggccccggcaaggtgttcggcgagctggccatcctgtacaactgcaccagaaccgccaccgtgaagaccctggtgaacgtgaagctgtgggccatcgacagacagtgcttccagaccatcatgatgagaaccggcctgatcaagcacaccgagtacatggagttcctgaagagcgtgcccaccttccagagcctgcccgaggagatcctgagcaagctggccgacgtgctggaggagacccactacgagaacggcgagtacatcatcagacagggcgccagaggcgacaccttcttcatcatcagcaagggcaccgtgaacgtgaccagagaggacagccccagcgaggaccccgtgttcctgagaaccctgggcaagggcgactggttcggcgagaaggccctgcagggcgaggacgtgagaaccgccaacgtgatcgccgccgaggccgtgacctgcctggtgatcgacagagacagcttcaagcacctgatcggcggcctggacgacgtgagcaacaaggcctacgaggacgccgaggccaaggccaagtacgaggccgaggccgccttcttcgccaacctgaagctgagcgacttcaacatcatcgacaccctgggcgtgggcggcttcggcagagtggagctggtgcagctgaagagcgaggagagcaagaccttcgccatgaagatcctgaagaagagacacatcgtggacaccagacagcaggagcacatcagaagcgagaagcagatcatgcagggcgcccacagcgacttcatcgtgagactgtacagaaccttcaaggacagcaagtacctgtacatgctgatggaggcctgcctgggcggcgagctgtggaccatcctgagagacagaggcagcttcgaggacagcaccaccagattctacaccgcctgcgtggtggaggccttcgcctacctgcacagcaagggcatcatctacagagacctgaagcccgagaacctgatcctggaccacagaggctacgccaagctggtggacttcggcttcgccaagaagatcggcttcggcaagaagacctggaccttctgcggcacccccgagtacgtggcccccgagatcatcctgaacaagggccacgacatcagcgccgactactggagcctgggcatcctgatgtacgagctgctgaccggcagcccccccttcagcggccccgaccccatgaagacctacaacatcatcctgagaggcatcgacatgatcgagttccccaagaagatcgccaagaacgccgccaacctgatcaagaagctgtgcagagacaaccccagcgagagactgggcaacctgaagaacggcgtgaaggacatccagaagcacaagtggttcgagggcttcaactgggagggcctgagaaagggcaccctgaccccccccatcatccccagcgtggccagccccaccgacaccagcaacttcgacagcttccccgaggacaacgacgagcccccccccgacgacaacagcggctgggacatcgacttctag

SEQ ID NO: 95209 - DNA, 2289 bp, Artificial Sequence
  Description of Artificial Sequence: Synthetic coding sequence
atgggcaacggcagcgtgaagcccaagcacagcaagcaccccgacggccacagcggcaacctgaccaccgacgccctgagaaacaaggtgaccgagctggagagagagctgagaagaaaggacgccgagatccaggagagagagtaccacctgaaggagctgagagagcagctgagcaagcagaccgtggccatcgccgagctgaccgaggagctgcagaacaagtgcatccagctgaacaagctgcaggacgtggtgcacatgcagggcggcagccccctgcaggccagccccgacaaggtgcccctggaggtgcacagaaagaccagcggcctggtgagcctgcacagcagaagaggcgccaaggccggcgtgagcgccgagcccaccaccagaacctacgacctgaacaagccccccgagttcagcttcgagaaggccagagtgagaaaggacagcagcgagaagaagctgatcaccgacgccctgaacaagaaccagttcctgaagagactggacccccagcagatcaaggacatggtggagtgcatgtacggcagaaactaccagcagggcagctacatcatcaagcagggcgagcccggcaaccacatcttcgtgctggccgagggcagactggaggtgttccagggcgagaagctgctgagcagcatccccatgtggaccaccttcggcgagctggccatcctgtacaactgcaccagaaccgccagcgtgaaggccatcaccaacgtgaagacctgggccctggacagagaggtgttccagaacatcatgagaagaaccgcccaggccagagacgagcagtacagaaacttcctgagaagcgtgagcctgctgaagaacctgcccgaggacaagctgaccaagatcatcgactgcctggaggtggagtactacgacaagggcgactacatcatcagagagggcgaggagggcagcaccttcttcatcctggccaagggcaaggtgaaggtgacccagagcaccgagggccacgaccagccccagctgatcaagaccctgcagaagggcgagtacttcggcgagaaggccctgatcagcgacgacgtgagaagcgccaacatcatcgccgaggagaacgacgtggcctgcctggtgatcgacagagagaccttcaaccagaccgtgggcaccttcgaggagctgcagaagtacctggagggctacgtggccaacctgaacagagacgacgagaagagacacgccaagagaagcatgagcaactggaagctgagcaaggccctgagcctggagatgatccagctgaaggagaaggtggccagattcagcagcagcagccccttccagaacctggagatcatcgccaccctgggcgtgggcggcttcggcagagtggagctggtgaaggtgaagaacgagaacgtggccttcgccatgaagtgcatcagaaagaagcacatcgtggacaccaagcagcaggagcacgtgtacagcgagaagagaatcctggaggagctgtgcagccccttcatcgtgaagctgtacagaaccttcaaggacaacaagtacgtgtacatgctgctggaggcctgcctgggcggcgagctgtggagcatcctgagagacagaggcagcttcgacgagcccaccagcaagttctgcgtggcctgcgtgaccgaggccttcgactacctgcacagactgggcatcatctacagagacctgaagcccgagaacctgatcctggacgccgagggctacctgaagctggtggacttcggcttcgccaagaagatcggcagcggccagaagacctggaccttctgcggcacccccgagtacgtggcccccgaggtgatcctgaacaagggccacgacttcagcgtggacttctggagcctgggcatcctggtgtacgagctgctgaccggcaacccccccttcagcggcgtggaccagatgatgacctacaacctgatcctgaagggcatcgagaagatggacttccccagaaagatcaccagaagacccgaggacctgatcagaagactgtgcagacagaaccccaccgagagactgggcaacctgaagaacggcatcaacgacatcaagaagcacagatggctgaacggcttcaactgggagggcctgaaggccagaagcctgcccagccccctgcagagagagctgaagggccccatcgaccacagctacttcgacaagtacccccccgagaagggcatgccccccgacgagctgagcggctgggacaaggacttctag

SEQ ID NO: 95210 - DNA, 2289 bp, Artificial Sequence; identical to SEQ ID NO: 95209
  Description of Artificial Sequence: Synthetic coding sequence

SEQ ID NO: 95211 - DNA, 2202 bp, Artificial Sequence
  Description of Artificial Sequence: Synthetic coding sequence
atgggcaacggcagcgtgaagcccaagcacagcaagcaccccgacggccacagcggcaacctgaccaccgacgccctgagaaacaaggtgaccgagctggagagagagctgagaagaaaggacgccgagatccaggagagagagtaccacctgaaggagctgagagagcagctgagcaagcagaccgtggccatcgccgagctgaccgaggagctgcagaacaagtgcatccagctgaacaagctgcaggacgtggtgcacatgcagggcggcagccccctgcaggccagccccgacaaggtgcccctggaggtgcacagaaagaccagcggcctggtgagcctgcacagcagaagaggcgccaaggccggcgtgagcgccgagcccaccaccagaacctacgacctgaacaagccccccgagttcagcttcgagaaggccagagtgagaaaggacagcagcgagaagaagctgatcaccgacgccctgaacaagaaccagttcctgaagagactggacccccagcagatcaaggacatggtggagtgcatgtacggcagaaactaccagcagggcagctacatcatcaagcagggcgagcccggcaaccacatcttcgtgctggccgagggcagactggaggtgttccagggcgagaagctgctgagcagcatccccatgtggaccaccttcggcgagctggccatcctgtacaactgcaccagaaccgccagcgtgaaggccatcaccaacgtgaagacctgggccctggacagagaggtgttccagaacatcatgagaagaaccgcccaggccagagacgagcagtacagaaacttcctgagaagcgtgagcctgctgaagaacctgcccgaggacaagctgaccaagatcatcgactgcctggaggtggagtactacgacaagggcgactacatcatcagagagggcgaggagggcagcaccttcttcatcctggccaagggcaaggtgaaggtgacccagagcaccgagggccacgaccagccccagctgatcaagaccctgcagaagggcgagtacttcggcgagaaggccctgatcagcgacgacgtgagaagcgccaacatcatcgccgaggagaacgacgtggcctgcctggtgatcgacagagagaccttcaaccagaccgtgggcaccttcgaggagctgcagaagtacctggagggctacgtggccaacctgaacagagacgacgagaagagacacgccaagagaagcatgagcaactggaagctgagcaaggccctgagcctggagatgatccagctgaaggagaaggtgaaggtgaagaacgagaacgtggccttcgccatgaagtgcatcagaaagaagcacatcgtggacaccaagcagcaggagcacgtgtacagcgagaagagaatcctggaggagctgtgcagccccttcatcgtgaagctgtacagaaccttcaaggacaacaagtacgtgtacatgctgctggaggcctgcctgggcggcgagctgtggagcatcctgagagacagaggcagcttcgacgagcccaccagcaagttctgcgtggcctgcgtgaccgaggccttcgactacctgcacagactgggcatcatctacagagacctgaagcccgagaacctgatcctggacgccgagggctacctgaagctggtggacttcggcttcgccaagaagatcggcagcggccagaagacctggaccttctgcggcacccccgagtacgtggcccccgaggtgatcctgaacaagggccacgacttcagcgtggacttctggagcctgggcatcctggtgtacgagctgctgaccggcaacccccccttcagcggcgtggaccagatgatgacctacaacctgatcctgaagggcatcgagaagatggacttccccagaaagatcaccagaagacccgaggacctgatcagaagactgtgcagacagaaccccaccgagagactgggcaacctgaagaacggcatcaacgacatcaagaagcacagatggctgaacggcttcaactgggagggcctgaaggccagaagcctgcccagccccctgcagagagagctgaagggccccatcgaccacagctacttcgacaagtacccccccgagaagggcatgccccccgacgagctgagcggctgggacaaggacttctag

SEQ ID NO: 95212 - DNA, 1029 bp, Artificial Sequence
  Description of Artificial Sequence: Synthetic coding sequence
atgagcaactggaagctgagcaaggccctgagcctggagatgatccagctgaaggagaaggtggccagattcagcagcagcagccccttccagaacctggagatcatcgccaccctgggcgtgggcggcttcggcagagtggagctggtgaaggtgaagaacgagaacgtggccttcgccatgaagtgcatcagaaagaagcacatcgtggacaccaagcagcaggagcacgtgtacagcgagaagagaatcctggaggagctgtgcagccccttcatcgtgaagctgtacagaaccttcaaggacaacaagtacgtgtacatgctgctggaggcctgcctgggcggcgagctgtggagcatcctgagagacagaggcagcttcgacgagcccaccagcaagttctgcgtggcctgcgtgaccgaggccttcgactacctgcacagactgggcatcatctacagagacctgaagcccgagaacctgatcctggacgccgagggctacctgaagctggtggacttcggcttcgccaagaagatcggcagcggccagaagacctggaccttctgcggcacccccgagtacgtggcccccgaggtgatcctgaacaagggccacgacttcagcgtggacttctggagcctgggcatcctggtgtacgagctgctgaccggcaacccccccttcagcggcgtggaccagatgatgacctacaacctgatcctgaagggcatcgagaagatggacttccccagaaagatcaccagaagacccgaggacctgatcagaagactgtgcagacagaaccccaccgagagactgggcaacctgaagaacggcatcaacgacatcaagaagcacagatggctgaacggcttcaactgggagggcctgaaggccagaagcctgcccagccccctgcagagagagctgaagggccccatcgaccacagctacttcgacaagtacccccccgagaagggcatgccccccgacgagctgagcggctgggacaaggacttctag

SEQ ID NO: 95213 - DNA, 942 bp, Artificial Sequence
  Description of Artificial Sequence: Synthetic coding sequence
atgagccagagcagacacagagccgaggccccccccctggagagagaggacagcggcaccttcagcctgggcaagatgatcaccgccaagcccggcaagacccccatccaggtgctgcacgagtacggcatgaagaccaagaacatccccgtgtacgagtgcgagagaagcgacgtgcagatccacgtgcccaccttcaccttcagagtgaccgtgggcgacatcacctgcaccggcgagggcaccagcaagaagctggccaagcacagagccgccgaggccgccatcaacatcctgaaggccaacgccagcatctgcttcgccgtgcccgaccccctgatgcccgaccccagcaagcagcccaagaaccagctgaaccccatcggcagcctgcaggagctggccatccaccacggctggagactgcccgagtacaccctgagccaggagggcggccccgcccacaagagagagtacaccaccatctgcagactggagagcttcatggagaccggcaagggcgccagcaagaagcaggccaagagaaacgccgccgagaagttcctggccaagttcagcaacatcagccccgagaaccacatcagcctgaccaacgtggtgggccacagcctgggctgcacctggcacagcctgagaaacagccccggcgagaagatcaacctgctgaagagaagcctgctgagcatccccaacaccgactacatccagctgctgagcgagatcgccaaggagcagggcttcaacatcacctacctggacatcgacgagctgagcgccaacggccagtaccagtgcctggccgagctgagcaccagccccatcaccgtgtgccacggcagcggcatcagctgcggcaacgcccagagcgacgccgcccacaacgccctgcagtacctgaagatcatcgccgagagaaagtag

SEQ ID NO: 95214 - DNA, 909 bp, Artificial Sequence
  Description of Artificial Sequence: Synthetic coding sequence
atgcagagcacccccttctgcggcttctgcagcctgggcaagatgatcaccgccaagcccggcaagacccccatccaggtgctgcacgagtacggcatgaagaccaagaacatccccgtgtacgagtgcgagagaagcgacgtgcagatccacgtgcccaccttcaccttcagagtgaccgtgggcgacatcacctgcaccggcgagggcaccagcaagaagctggccaagcacagagccgccgaggccgccatcaacatcctgaaggccaacgccagcatctgcttcgccgtgcccgaccccctgatgcccgaccccagcaagcagcccaagaaccagctgaaccccatcggcagcctgcaggagctggccatccaccacggctggagactgcccgagtacaccctgagccaggagggcggccccgcccacaagagagagtacaccaccatctgcagactggagagcttcatggagaccggcaagggcgccagcaagaagcaggccaagagaaacgccgccgagaagttcctggccaagttcagcaacatcagccccgagaaccacatcagcctgaccaacgtggtgggccacagcctgggctgcacctggcacagcctgagaaacagccccggcgagaagatcaacctgctgaagagaagcctgctgagcatccccaacaccgactacatccagctgctgagcgagatcgccaaggagcagggcttcaacatcacctacctggacatcgacgagctgagcgccaacggccagtaccagtgcctggccgagctgagcaccagccccatcaccgtgtgccacggcagcggcatcagctgcggcaacgcccagagcgacgccgcccacaacgccctgcagtacctgaagatcatcgccgagagaaagtag

SEQ ID NO: 95215 - DNA, 603 bp, Artificial Sequence
  Description of Artificial Sequence: Synthetic coding sequence
atgcccgaccccagcaagcagcccaagaaccagctgaaccccatcggcagcctgcaggagctggccatccaccacggctggagactgcccgagtacaccctgagccaggagggcggccccgcccacaagagagagtacaccaccatctgcagactggagagcttcatggagaccggcaagggcgccagcaagaagcaggccaagagaaacgccgccgagaagttcctggccaagttcagcaacatcagccccgagaaccacatcagcctgaccaacgtggtgggccacagcctgggctgcacctggcacagcctgagaaacagccccggcgagaagatcaacctgctgaagagaagcctgctgagcatccccaacaccgactacatccagctgctgagcgagatcgccaaggagcagggcttcaacatcacctacctggacatcgacgagctgagcgccaacggccagtaccagtgcctggccgagctgagcaccagccccatcaccgtgtgccacggcagcggcatcagctgcggcaacgcccagagcgacgccgcccacaacgccctgcagtacctgaagatcatcgccgagagaaagtag

SEQ ID NO: 95216 - DNA, 867 bp, Artificial Sequence
  Description of Artificial Sequence: Synthetic coding sequence
atgatcaccgccaagcccggcaagacccccatccaggtgctgcacgagtacggcatgaagaccaagaacatccccgtgtacgagtgcgagagaagcgacgtgcagatccacgtgcccaccttcaccttcagagtgaccgtgggcgacatcacctgcaccggcgagggcaccagcaagaagctggccaagcacagagccgccgaggccgccatcaacatcctgaaggccaacgccagcatctgcttcgccgtgcccgaccccctgatgcccgaccccagcaagcagcccaagaaccagctgaaccccatcggcagcctgcaggagctggccatccaccacggctggagactgcccgagtacaccctgagccaggagggcggccccgcccacaagagagagtacaccaccatctgcagactggagagcttcatggagaccggcaagggcgccagcaagaagcaggccaagagaaacgccgccgagaagttcctggccaagttcagcaacatcagccccgagaaccacatcagcctgaccaacgtggtgggccacagcctgggctgcacctggcacagcctgagaaacagccccggcgagaagatcaacctgctgaagagaagcctgctgagcatccccaacaccgactacatccagctgctgagcgagatcgccaaggagcagggcttcaacatcacctacctggacatcgacgagctgagcgccaacggccagtaccagtgcctggccgagctgagcaccagccccatcaccgtgtgccacggcagcggcatcagctgcggcaacgcccagagcgacgccgcccacaacgccctgcagtacctgaagatcatcgccgagagaaagtag

SEQ ID NO: 95217 - DNA, 1077 bp, Artificial Sequence
  Description of Artificial Sequence: Synthetic coding sequence
atggaggcccccggcctggcccaggccgccgccgccgagagcgacagcagaaaggtggccgaggagacccccgacggcgcccccgccctgtgccccagccccgaggccctgagccccgagccccccgtgtacagcctgcaggacttcgacaccctggccaccgtgggcaccggcaccttcggcagagtgcacctggtgaaggagaagaccgccaagcacttcttcgccctgaaggtgatgagcatccccgacgtgatcagactgaagcaggagcagcacgtgcacaacgagaagagcgtgctgaaggaggtgagccaccccttcctgatcagactgttctggacctggcacgacgagagattcctgtacatgctgatggagtacgtgcccggcggcgagctgttcagctacctgagaaacagaggcagattcagcagcaccaccggcctgttctacagcgccgagatcatctgcgccatcgagtacctgcacagcaaggagatcgtgtacagagacctgaagcccgagaacatcctgctggacagagacggccacatcaagctgaccgacttcggcttcgccaagaagctggtggacagaacctggaccctgtgcggcacccccgagtacctggcccccgaggtgatccagagcaagggccacggcagagccgtggactggtgggccctgggcatcctgatcttcgagatgctgagcggcttcccccccttcttcgacgacaaccccttcggcatctaccagaagatcctggccggcaagatcgacttccccagacacctggacttccacgtgaaggacctgatcaagaagctgctggtggtggacagaaccagaagactgggcaacatgaagaacggcgccaacgacgtgaagcaccacagatggttcagaagcgtggactgggaggccgtgccccagagaaagctgaagccccccatcgtgcccaagatcgccggcgacggcgacaccagcaacttcgagacctaccccgagaacgactgggacaccgccgcccccgtgccccagaaggacctggagatcttcaagaacttctag

SEQ ID NO: 95218 - DNA, 1983 bp, Artificial Sequence
  Description of Artificial Sequence: Synthetic coding sequence
atggacgactggaagcccagccccctgatcaagcccttcggcgccagaaagaagagaagctggtacctgacctggaagtacaagctgaccaaccagagagccctgagaagattctgccagaccggcgccgtgctgttcctgctggtgaccgtgatcgtgaacatcaagctgatcctggacaccagaagagccatcagcgaggccaacgaggaccccgagcccgagcaggactacgacgaggccctgggcagactggagccccccagaagaagaggcagcggccccagaagagtgctggacgtggaggtgtacagcagcagaagcaaggtgtacgtggccgtggacggcaccaccgtgctggaggacgaggccagagagcagggcagaggcatccacgtgatcgtgctgaaccaggccaccggccacgtgatggccaagagagtgttcgacacctacagcccccacgaggacgaggccatggtgctgttcctgaacatggtggcccccggcagagtgctgatctgcaccgtgaaggacgagggcagcttccacctgaaggacaccgccaaggccctgctgagaagcctgggcagccaggccggccccgccctgggctggagagacacctgggccttcgtgggcagaaagggcggccccgtgttcggcgagaagcacagcaagagccccgccctgagcagctggggcgaccccgtgctgctgaagaccgacgtgcccctgagcagcgccgaggaggccgagtgccactgggccgacaccgagctgaacagaagaagaagaagattctgcagcaaggtggagggctacggcagcgtgtgcagctgcaaggaccccacccccatcgagttcagccccgaccccctgcccgacaacaaggtgctgaacgtgcccgtggccgtgatcgccggcaacagacccaactacctgtacagaatgctgagaagcctgctgagcgcccagggcgtgagcccccagatgatcaccgtgttcatcgacggctactacgaggagcccatggacgtggtggccctgttcggcctgagaggcatccagcacacccccatcagcatcaagaacgccagagtgagccagcactacaaggccagcctgaccgccaccttcaacctgttccccgaggccaagttcgccgtggtgctggaggaggacctggacatcgccgtggacttcttcagcttcctgagccagagcatccacctgctggaggaggacgacagcctgtactgcatcagcgcctggaacgaccagggctacgagcacaccgccgaggaccccgccctgctgtacagagtggagaccatgcccggcctgggctgggtgctgagaagaagcctgtacaaggaggagctggagcccaagtggcccacccccgagaagctgtgggactgggacatgtggatgagaatgcccgagcagagaagaggcagagagtgcatcatccccgacgtgagcagaagctaccacttcggcatcgtgggcctgaacatgaacggctacttccacgaggcctacttcaagaagcacaagttcaacaccgtgcccggcgtgcagctgagaaacgtggacagcctgaagaaggaggcctacgaggtggaggtgcacagactgctgagcgaggccgaggtgctggaccacagcaagaacccctgcgaggacagcttcctgcccgacaccgagggccacacctacgtggccttcatcagaatggagaaggacgacgacttcaccacctggacccagctggccaagtgcctgcacatctgggacctggacgtgagaggcaaccacagaggcctgtggagactgttcagaaagaagaaccacttcctgatggtgggcgtgcccgccagcccctacagcgtgaagaagccccccagcgtgacccccatcttcctggagcccccccccaaggaggagggcgcccccggcgcccccgagcagacctag

SEQ ID NO: 95219 - DNA, 2247 bp, Artificial Sequence
  Description of Artificial Sequence: Synthetic coding sequence
atggacgactggaagcccagccccctgatcaagcccttcggcgccagaaagaagagaagctggtacctgacctggaagtacaagctgaccaaccagagagccctgagaagattctgccagaccggcgccgtgctgttcctgctggtgaccgtgatcgtgaacatcaagctgatcctggacaccagaagagccatcagcgaggccaacgaggaccccgagcccgagcaggactacgacgaggccctgggcagactggagccccccagaagaagaggcagcggccccagaagagtgctggacgtggaggtgtacagcagcagaagcaaggtgtacgtggccgtggacggcaccaccgtgctggaggacgaggccagagagcagggcagaggcatccacgtgatcgtgctgaaccaggccaccggccacgtgatggccaagagagtgttcgacacctacagcccccacgaggacgaggccatggtgctgttcctgaacatggtggcccccggcagagtgctgatctgcaccgtgaaggacgagggcagcttccacctgaaggacaccgccaaggccctgctgagaagcctgggcagccaggccggccccgccctgggctggagagacacctgggccttcgtgggcagaaagggcggccccgtgttcggcgagaagcacagcaagagccccgccctgagcagctggggcgaccccgtgctgctgaagaccgacgtgcccctgagcagcgccgaggaggccgagtgccactgggccgacaccgagctgaacagaagaagaagaagattctgcagcaaggtggagggctacggcagcgtgtgcagctgcaaggaccccacccccatcgagttcagccccgaccccctgcccgacaacaaggtgctgaacgtgcccgtggccgtgatcgccggcaacagacccaactacctgtacagaatgctgagaagcctgctgagcgcccagggcgtgagcccccagatgatcaccgtgttcatcgacggctactacgaggagcccatggacgtggtggccctgttcggcctgagaggcatccagcacacccccatcagcatcaagaacgccagagtgagccagcactacaaggccagcctgaccgccaccttcaacctgttccccgaggccaagttcgccgtggtgctggaggaggacctggacatcgccgtggacttcttcagcttcctgagccagagcatccacctgctggaggaggacgacagcctgtactgcatcagcgcctggaacgaccagggctacgagcacaccgccgaggaccccgccctgctgtacagagtggagaccatgcccggcctgggctgggtgctgagaagaagcctgtacaaggaggagctggagcccaagtggcccacccccgagaagctgtgggactgggacatgtggatgagaatgcccgagcagagaagaggcagagagtgcatcatccccgacgtgagcagaagctaccacttcggcatcgtgggcctgaacatgaacggctacttccacgaggcctacttcaagaagcacaagttcaacaccgtgcccggcgtgcagctgagaaacgtggacagcctgaagaaggaggcctacgaggtggaggtgcacagactgctgagcgaggccgaggtgctggaccacagcaagaacccctgcgaggacagcttcctgcccgacaccgagggccacacctacgtggccttcatcagaatggagaaggacgacgacttcaccacctggacccagctggccaagtgcctgcacatctgggacctggacgtgagaggcaaccacagaggcctgtggagactgttcagaaagaagaaccacttcctgatgagcgaggaggccaccctgagccaccccaacttccccggcgccacccccaagggcggcggcagccccagaagccccagaaccgacatgagacccccccccggcccctgcggcgccggccccggcagcgagagcaacctgttcatcgactgccccgagggcctggagaacagacccaacctggagggcctggacttcttcctgggctggaacgccgccctgagagtgggcctggccctgacccaggagaccgccgtgcccaacccctggaccggccccgccggcgcccacatgctgacccagacccacagcgagaccctgagacactggaccagaccccccctgagcctgctgttcgtgcagatcagcaaggccggctag

SEQ ID NO: 95220 - DNA, 2247 bp, Artificial Sequence; identical to SEQ ID NO: 95219
  Description of Artificial Sequence: Synthetic coding sequence

SEQ ID NO: 95221 - DNA, 603 bp, Artificial Sequence
  Description of Artificial Sequence: Synthetic coding sequence
atggacgactggaagcccagccccctgatcaagcccttcggcgccagaaagaagagaagctggtacctgacctggaagtacaagctgaccaaccagagagccctgagaagattctgccagaccggcgccgtgctgttcctgctggtgaccgtgatcgtgaacatcaagctgatcctggacaccagaagagccatcagcgaggccaacgaggaccccgagcccgagcaggactacgacgaggccctgggcagactggagccccccagaagaagaggcagcggccccagaagagtgctggacgtggaggtgtacagcagcagaagcaaggtgtacgtggccgtggacggcaccaccgtgctggaggacgaggccagagagcagggcagaggcatccacgtgatcgtgctgaaccaggccaccggccacgtgatggccaagagagtgttcgacacctacagcccccacgaggacgaggccatggtgctgttcctgaacatggtggcccccggcagagtgctgatctgcaccgtgaaggtgctgagcagcggcagaaacatcctgaaccacctgcccagcctgcccggcggcacccagagctgctag

SEQ ID NO: 95222 - DNA, 1917 bp, Artificial Sequence
  Description of Artificial Sequence: Synthetic coding sequence
atggagggcaccaaggagatcaaggtgagcaacagaagaatccaggagcactggaccggcgccgtgctgttcctgctggtgaccgtgatcgtgaacatcaagctgatcctggacaccagaagagccatcagcgaggccaacgaggaccccgagcccgagcaggactacgacgaggccctgggcagactggagccccccagaagaagaggcagcggccccagaagagtgctggacgtggaggtgtacagcagcagaagcaaggtgtacgtggccgtggacggcaccaccgtgctggaggacgaggccagagagcagggcagaggcatccacgtgatcgtgctgaaccaggccaccggccacgtgatggccaagagagtgttcgacacctacagcccccacgaggacgaggccatggtgctgttcctgaacatggtggcccccggcagagtgctgatctgcaccgtgaaggacgagggcagcttccacctgaaggacaccgccaaggccctgctgagaagcctgggcagccaggccggccccgccctgggctggagagacacctgggccttcgtgggcagaaagggcggccccgtgttcggcgagaagcacagcaagagccccgccctgagcagctggggcgaccccgtgctgctgaagaccgacgtgcccctgagcagcgccgaggaggccgagtgccactgggccgacaccgagctgaacagaagaagaagaagattctgcagcaaggtggagggctacggcagcgtgtgcagctgcaaggaccccacccccatcgagttcagccccgaccccctgcccgacaacaaggtgctgaacgtgcccgtggccgtgatcgccggcaacagacccaactacctgtacagaatgctgagaagcctgctgagcgcccagggcgtgagcccccagatgatcaccgtgttcatcgacggctactacgaggagcccatggacgtggtggccctgttcggcctgagaggcatccagcacacccccatcagcatcaagaacgccagagtgagccagcactacaaggccagcctgaccgccaccttcaacctgttccccgaggccaagttcgccgtggtgctggaggaggacctggacatcgccgtggacttcttcagcttcctgagccagagcatccacctgctggaggaggacgacagcctgtactgcatcagcgcctggaacgaccagggctacgagcacaccgccgaggaccccgccctgctgtacagagtggagaccatgcccggcctgggctgggtgctgagaagaagcctgtacaaggaggagctggagcccaagtggcccacccccgagaagctgtgggactgggacatgtggatgagaatgcccgagcagagaagaggcagagagtgcatcatccccgacgtgagcagaagctaccacttcggcatcgtgggcctgaacatgaacggctacttccacgaggcctacttcaagaagcacaagttcaacaccgtgcccggcgtgcagctgagaaacgtggacagcctgaagaaggaggcctacgaggtggaggtgcacagactgctgagcgaggccgaggtgctggaccacagcaagaacccctgcgaggacagcttcctgcccgacaccgagggccacacctacgtggccttcatcagaatggagaaggacgacgacttcaccacctggacccagctggccaagtgcctgcacatctgggacctggacgtgagaggcaaccacagaggcctgtggagactgttcagaaagaagaaccacttcctgatggtgggcgtgcccgccagcccctacagcgtgaagaagccccccagcgtgacccccatcttcctggagcccccccccaaggaggagggcgcccccggcgcccccgagcagacctag

SEQ ID NO: 95223 - DNA, 861 bp, Artificial Sequence
  Description of Artificial Sequence: Synthetic coding sequence
atgagcgacagcgagaagctgaacctggacagcatcatcggcagactgctggagggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgcagggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgacaagaacaagggcaagtacggccagttcagcggcctgaaccccggcggcagacccatcaccccccccagaaacagcgccaaggccaagaagtag

SEQ ID NO: 95224 - DNA, 1548 bp, Artificial Sequence
  Description of Artificial Sequence: Synthetic coding sequence
atggccgagctggagcacctgggcggcaagagagccgagagcgccagaatgagaagagccgagcagctgagaagatggagaggcagcctgaccgagcaggagcccgccgagagaagaggcgccggcagacagcccctgaccagaagaggcagccccagagtgagattcgaggacggcgccgtgttcctggccgcctgcagcagcggcgacaccgacgaggtgagaaagctgctggccagaggcgccgacatcaacaccgtgaacgtggacggcctgaccgccctgcaccaggcctgcatcgacgagaacctggacatggtgaagttcctggtggagaacagagccaacgtgaaccagcaggacaacgagggctggacccccctgcacgccgccgccagctgcggctacctgaacatcgccgagtacttcatcaaccacggcgccagcgtgggcatcgtgaacagcgagggcgaggtgcccagcgacctggccgaggagcccgccatgaaggacctgctgctggagcaggtgaagaagcagggcgtggacctggagcagagcagaaaggaggaggagcagcagatgctgcaggacgccagacagtggctgaacagcggcaagatcgaggacgtgagacaggccagaagcggcgccaccgccctgcacgtggccgccgccaagggctacagcgaggtgctgagactgctgatccaggccggctacgagctgaacgtgcaggactacgacggctggacccccctgcacgccgccgcccactggggcgtgaaggaggcctgcagcatcctggccgaggccctgtgcgacatggacatcagaaacaagctgggccagacccccttcgacgtggccgacgagggcctggtggagcacctggagctgctgcagaagaagcagaacgtgctgagaagcgagaaggagaccagaaacaagctgatcgagagcgacctgaacagcaagatccagagcggcttcttcaagaacaaggagaagatgctgtacgaggaggagacccccaagagccaggagatggaggaggagaacaaggagagcagcagcagcagcagcgaggaggaggagggcgaggacgaggccagcgagagcgagaccgagaaggaggccgacaagaagcccgaggccttcgtgaaccacagcaacagcgagagcaagagcagcatcaccgagcagatccccgcccccgcccagaacaccttcagcgccagcagcgccagaagattcagcagcggcctgttcaacaagcccgaggagcccaaggacgagagccccagcagctggagactgggcctgagaaagaccggcagccacaacatgctgagcgaggtggccaacagcagagagcccatcagagacagaggcagcagcatctacagaagcagcagcagccccagaatcagcgccctgctggacaacaaggacaaggtgcagttcggcagagtgtggggcaacagcaaggccgtgttcttcttccacgagaacagcatcctgggcaccaacgagaacatcttctag

SEQ ID NO: 95225 - DNA, 4125 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggcgagcagaagaccaaggagggcgagggcagccagcagagcagaggcagaaagtacggcagcaacgtgaacagaatcaagaacctgttcatgcagatgggcatggagcccaacgagaacgccgccgtgatcgccaagaccagaggcaagggcggccacagcagcccccagagaagaatgaagcccaaggagttcctggagaagaccgacggcagcgtggtgaagctggagagcagcgtgagcgagagaatcagcagattcgacaccatgtacgacggccccagctacagcaagttcaccgagaccagaaagatgttcgagagaagcgtgcacgagagcggccagaacaacagatacagccccaagaaggagaaggccggcggcagcgagccccaggacgagtggggcggcagcaagagcaacagaggcagcaccgacagcctggacagcctgagcagcagaaccgaggccgtgagccccaccgtgagccagctgagcgccgtgttcgagaacaccgacagccccagcgccatcatcagcgagaaggccgagaacaacgagtacagcgtgaccggccactaccccctgaacctgcccagcgtgaccgtgaccaacctggacaccttcggccacctgaaggacagcaacagctggccccccagcaacaagagaggcgtggacaccgaggacgcccacaagagcaacgccacccccgtgcccgaggtggccagcaagagcaccagcctggccagcatccccggcgaggagatccagcagagcaaggagcccgaggacagcaccagcaaccagcagacccccgacagcatcgacaaggacggccccgaggagccctgcgccgagagcaaggccatgcccaagagcgagatccccagcccccagagccagctgctggaggacgccgaggccaacctggtgggcagagaggccgccaagcagcagagaaaggagctggccggcggcgacttcaccagccccgacgccagcgccagcagctgcggcaaggaggtgcccgaggacagcaacaacttcgacggcagccacgtgtacatgcacagcgactacaacgtgtacagagtgagaagcagatacaacagcgactggggcgagaccggcaccgagcaggacgaggaggaggacagcgacgagaacagctactaccagcccgacatggagtacagcgagatcgtgggcctgcccgaggaggaggagatccccgccaacagaaagatcaagttcagcagcgcccccatcaaggtgttcaacacctacagcaacgaggactacgacagaagaaacgacgaggtggaccccgtggccgccagcgccgagtacgagctggagaagagagtggagaagctggagctgttccccgtggagctggagaaggacgaggacggcctgggcatcagcatcatcggcatgggcgtgggcgccgacgccggcctggagaagctgggcatcttcgtgaagaccgtgaccgagggcggcgccgcccagagagacggcagaatccaggtgaacgaccagatcgtggaggtggacggcatcagcctggtgggcgtgacccagaacttcgccgccaccgtgctgagaaacaccaagggcaacgtgagattcgtgatcggcagagagaagcccggccaggtgagcgaggtggcccagctgatcagccagaccctggagcaggagagaagacagagagagctgctggagcagcactacgcccagtacgacgccgacgacgacgagaacaccgtggccgagctgcagggcatgagcggcaactgcaacaacaacaacaactacttcctgaagaccggcgagtacgccaccgacgaggaggaggacgaggtgggccccgtgctgcccggcagcgacatggccatcgaggtgttcgagctgcccgagaacgaggacatgttcagccccagcgagctggacaccagcaagctgagccacaagttcaaggagctgcagatcaagcacgccgtgaccgaggccgagatccagaagctgaagaccaagctgcaggccgccgagaacgagaaggtgagatgggagctggagaagacccagctgcagcagaacatcgaggagaacaaggagagaatgctgaagctggagagctactggatcgaggcccagaccctgtgccacaccgtgaacgagcacctgaaggagacccagagccagtaccaggccctggagaagaagtacaacaaggccaagaagctgatcaaggacttccagcagaaggagctggacttcatcaagagacaggaggccgagagaaagaagatcgaggacctggagaaggcccacctggtggaggtgcagggcctgcaggtgagaatcagagacctggaggccgaggtgttcagactgctgaagcagaacggcacccaggtgaacaacaacaacaacatcttcgagagaagaaccagcctgggcgaggtgagcaagggcgacaccatggagaacctggacggcaagcagaccagctgccaggacggcctgagccaggacctgaacgaggccgtgcccgagaccgagagactggacagcaaggccctgaagaccagagcccagctgagcgtgaagaacagaagacagagacccagcagaaccagactgtacgacagcgtgagcagcaccgacggcgaggacagcctggagagaaagcccagcaacagcttctacaaccacatgcacatcaccaagctgctgccccccaagggcctgagaaccagcagccccgagagcgacagcggcgtgccccccctgacccccgtggacagcaacgtgcccttcagcagcgaccacatcgccgagttccaggaggagcccctggaccccgagatgggccccctgagcagcatgtggggcgacaccagcctgttcagcaccagcaagagcgaccacgacgtggaggagagcccctgccaccaccagaccaccaacaagaagatcctgagagagaaggacgacgccaaggaccccaagagcctgagagccagcagcagcctggccgtgcagggcggcaagatcaagagaaagttcgtggacctgggcgcccccctgagaagaaacagcagcaagggcaagaagtggaaggagaaggagaaggaggccagcagattcagcgccggcagcagaatcttcagaggcagactggagaactggacccccaagccctgcagcaccgcccagaccagcaccagaagcccctgcatgcccttcagctggttcaacgacagcagaaagggcagctacagcttcagaaacctgcccgcccccaccagcagcctgcagcccagccccgagaccctgatcagcgacaagaagggcagcaaggtggagaacacctggatcaccaaggccaacaagagaaaccccaaccccagcagcagcagcatcttcggcagacacagccagctgatgagcgtggtgtggatccaggagaccaacaacttcaccttcaacgacgacttcagccccagcagcaccagcagcgccgacctgagcggcctgggcgccgagcccaagacccccggcctgagccagagcctggccctgagcagcgacgagatcctggacgacggccagagccccaagcacagccagtgccagaacagagccgtgcaggagtggagcgtgcagcaggtgagccactggctgatgagcctgaacctggagcagtacgtgagcgagttcagcgcccagaacatcaccggcgagcagctgctgcagctggacggcaacaagctgaaggccctgggcatgaccgccagccaggacagagccgtggtgaagaagaagctgaaggagatgaagatgagcctggagaaggccagaaaggcccaggagaagatggagaagcagagagagaagctgagaagaaaggagcaggagcagatgcagagaaagagcaagaagaccgagaagatgaccagcaccaccgccgagggcgccggcgagcagtag

SEQ ID NO: 95226 - DNA, 1026 bp, Artificial Sequence
  Description of Artificial Sequence: Synthetic coding sequence
atgagcgacagcgagaagctgaacctggacagcatcatcggcagactgctggagggcagcagagtgctgaccccccactgcgcccccgtgcagggcagcagacccggcaagaacgtgcagctgaccgagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgcagggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgacaagaacaagggcaagtacggccagttcagcggcctgaaccccggcggcagacccatcaccccccccagaaacagcgccaaggccaagaagtag

SEQ ID NO: 95227 - DNA, 993 bp, Artificial Sequence
  Description of Artificial Sequence: Synthetic coding sequence
atgagcgacagcgagaagctgaacctggacagcatcatcggcagactgctggaggtgcagggcagcagacccggcaagaacgtgcagctgaccgagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgcagggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgacaagaacaagggcaagtacggccagttcagcggcctgaaccccggcggcagacccatcaccccccccagaaacagcgccaaggccaagaagtag

SEQ ID NO: 95228 - DNA, 1245 bp, Artificial Sequence
  Description of Artificial Sequence: Synthetic coding sequence
atgagacagagagccgacagaagaagcatggtgagcaccagcggcgccgccaccgccagcagcgccgccggccccagcagaggcgccgcccacagccccagcagcgccccccacgccagcagacacagaccccccttcagcagcagagccaccggcctgctgcagcagagacagcactgcgtgcaccactgcacccagctgtgccccagagtgcagaccccctgcctgccccccccccccgcccccgccaccgagctgcacagctacctgcagcagggcggcgagagaggcctgctggacaccacccccggcaccgccggctggggcaccagcgccaccggcgccgtgcagggcagcagacccggcaagaacgtgcagctgaccgagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgcagggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgacaagaacaagggcaagtacggccagttcagcggcctgaaccccggcggcagatag

SEQ ID NO: 95229 - DNA, 984 bp, Artificial Sequence
  Description of Artificial Sequence: Synthetic coding sequence
atggccgacggcgagctgaacgtggacagcctgatcaccagactgctggaggtgagaggctgcagacccggcaagatcgtgcagatgaccgaggccgaggtgagaggcctgtgcatcaagagcagagagatcttcctgagccagcccatcctgctggagctggaggcccccctgaagatctgcggcgacatccacggccagtacaccgacctgctgagactgttcgagtacggcggcttcccccccgaggccaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagattcaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgacaccggcctgctgtgcgacctgctgtggagcgaccccgacaaggacgtgcagggctggggcgagaacgacagaggcgtgagcttcaccttcggcgccgacgtggtgagcaagttcctgaacagacacgacctggacctgatctgcagagcccaccaggtggtggaggacggctacgagttcttcgccaagagacagctggtgaccctgttcagcgcccccaactactgcggcgagttcgacaacgccggcggcatgatgagcgtggacgagaccctgatgtgcagcttccagatcctgaagcccagcgagaagaaggccaagtaccagtacggcggcctgaacagcggcagacccgtgaccccccccagaaccgccaacccccccaagaagagatag

SEQ ID NO: 95230 - DNA, 984 bp, Artificial Sequence; identical to SEQ ID NO: 95229
  Description of Artificial Sequence: Synthetic coding sequence

SEQ ID NO: 95231 - DNA, 984 bp, Artificial Sequence; identical to SEQ ID NO: 95229
  Description of Artificial Sequence: Synthetic coding sequence

SEQ ID NO: 95232 - DNA, 378 bp, Artificial Sequence
  Description of Artificial Sequence: Synthetic coding sequence
atggccgacggcgagctgaacgtggacagcctgatcaccagactgctggaggtgagaggctgcagacccggcaagatcgtgcagatgaccgaggccgaggtgagaggcctgtgcatcaagagcagagagatcttcctgagccagcccatcctgctggagctggaggcccccctgaagatctgcggcgacatccacggccagtacaccgacctgctgagactgttcgagtacggcggcttcccccccgaggccaactacctgttcctgggcgactacgtggacagaggcaagcagagcctggagaccatctgcctgctgctggcctacaagatcaagtaccccgagaacttcttcctgctgagaggcaaccacgagtag

SEQ ID NO: 95233 - DNA, 417 bp, Artificial Sequence
  Description of Artificial Sequence: Synthetic coding sequence
atggccgacggcgagctgaacgtggacagcctgatcaccagactgctggaggtgagaggctgcagacccggcaagatcgtgcagatgaccgaggccgaggtgagaggcctgtgcatcaagagcagagagatcttcctgagccagcccatcctgctggagctggaggcccccctgaagatctgcggcgacatccacggccagtacaccgacctgctgagactgttcgagtacggcggcttcccccccgaggccaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtag

SEQ ID NO: 95234 - DNA, 510 bp, Artificial Sequence
  Description of Artificial Sequence: Synthetic coding sequence
atgaccgaggccgaggtgagaggcctgtgcatcaagagcagagagatcttcctgagccagcccatcctgctggagctggaggcccccctgaagatctgcggcgacatccacggccagtacaccgacctgctgagactgttcgagtacggcggcttcccccccgaggccaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagattcaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgacacctag

SEQ ID NO: 95235 - DNA, 972 bp, Artificial Sequence
  Description of Artificial Sequence: Synthetic coding sequence
atggccgacctggacaagctgaacatcgacagcatcatccagagactgctggaggtgagaggcagcaagcccggcaagaacgtgcagctgcaggagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgctgggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgagaagaagaagcccaacgccaccagacccgtgaccccccccagaggcatgatcaccaagcaggccaagaagtag

SEQ ID NO: 95236 - DNA, 1014 bp, Artificial Sequence
  Description of Artificial Sequence: Synthetic coding sequence
atggccgacctggacaagctgaacatcgacagcatcatccagagactgctggaggtgagaggcagcaagcccggcaagaacgtgcagctgcaggagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgctgggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgagaagaagaagcccaacgccaccagacccgtgaccccccccagagtggccagcggcctgaaccccagcatccagaaggccagcaactacagaaacaacaccgtgctgtacgagtag

SEQ ID NO: 95237 - DNA, 999 bp, Artificial Sequence
  Description of Artificial Sequence: Synthetic coding sequence
atgttcctgcccctgtacctgaacctggtgctgtacttcgtgttctggctgcactggaccaactgcgacttcagcctggccgtgagaggcagcaagcccggcaagaacgtgcagctgcaggagaacgagatcagaggcctgtgcctgaagagcagagagatcttcctgagccagcccatcctgctggagctggaggcccccctgaagatctgcggcgacatccacggccagtactacgacctgctgagactgttcgagtacggcggcttcccccccgagagcaactacctgttcctgggcgactacgtggacagaggcaagcagagcctggagaccatctgcctgctgctggcctacaagatcaagtaccccgagaacttcttcctgctgagaggcaaccacgagtgcgccagcatcaacagaatctacggcttctacgacgagtgcaagagaagatacaacatcaagctgtggaagaccttcaccgactgcttcaactgcctgcccatcgccgccatcgtggacgagaagatcttctgctgccacggcggcctgagccccgacctgcagagcatggagcagatcagaagaatcatgagacccaccgacgtgcccgaccagggcctgctgtgcgacctgctgtggagcgaccccgacaaggacgtgctgggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgagaagaagaagcccaacgccaccagacccgtgaccccccccagaggcatgatcaccaagcaggccaagaagtag

SEQ ID NO: 95238 - DNA, 426 bp, Artificial Sequence
  Description of Artificial Sequence: Synthetic coding sequence
atggagcagatcagaagaatcatgagacccaccgacgtgcccgaccagggcctgctgtgcgacctgctgtggagcgaccccgacaaggacgtgctgggctggggcgagaacgacagaggcgtgagcttcaccttcggcgccgaggtggtggccaagttcctgcacaagcacgacctggacctgatctgcagagcccaccaggtggtggaggacggctacgagttcttcgccaagagacagctggtgaccctgttcagcgcccccaactactgcggcgagttcgacaacgccggcgccatgatgagcgtggacgagaccctgatgtgcagcttccagatcctgaagcccgccgagaagaagaagcccaacgccaccagacccgtgaccccccccagaggcatgatcaccaagcaggccaagaagtag

SEQ ID NO: 95239 - DNA, 225 bp, Artificial Sequence
  Description of Artificial Sequence: Synthetic coding sequence
atgggcagaagaagcagcaagtgctgctgcatctacgagaagcccagagccttcggcgagagcagcaccgagagcgacgaggaggaggaggagggctgcggccacacccactgcgtgagaggccacagaaagggcagaagaagagccaccctgggccccacccccaccacccccccccagccccccgaccccagccagcccccccccggccccatgcagcactag

SEQ ID NO: 95240 - DNA, 225 bp, Artificial Sequence; identical to SEQ ID NO: 95239
  Description of Artificial Sequence: Synthetic coding sequence

SEQ ID NO: 95241 - DNA, 225 bp, Artificial Sequence; identical to SEQ ID NO: 95239
  Description of Artificial Sequence: Synthetic coding sequence

SEQ ID NO: 95242 - DNA, 225 bp, Artificial Sequence; identical to SEQ ID NO: 95239
  Description of Artificial Sequence: Synthetic coding sequence

SEQ ID NO: 95243 - DNA, 381 bp, Artificial Sequence
  Description of Artificial Sequence: Synthetic coding sequence
atggccgaggccggcgccggcctgagcgagaccgtgaccgagaccaccgtgaccgtgaccaccgagcccgagaacagaagcctgaccatcaagctgagaaagagaaagcccgagaagaaggtggagtggaccagcgacaccgtggacaacgagcacatgggcagaagaagcagcaagtgctgctgcatctacgagaagcccagagccttcggcgagagcagcaccgagagcgacgaggaggaggaggagggctgcggccacacccactgcgtgagaggccacagaaagggcagaagaagagccaccctgggccccacccccaccacccccccccagccccccgaccccagccagcccccccccggccccatgcagcactag

SEQ ID NO: 95244 - DNA, 225 bp, Artificial Sequence; identical to SEQ ID NO: 95239
  Description of Artificial Sequence: Synthetic coding sequence

SEQ ID NO: 95245 - DNA, 381 bp, Artificial Sequence; identical to SEQ ID NO: 95243
  Description of Artificial Sequence: Synthetic coding sequence

SEQ ID NO: 95246 - DNA, 225 bp, Artificial Sequence; identical to SEQ ID NO: 95239
  Description of Artificial Sequence: Synthetic coding sequence

SEQ ID NO: 95247 - DNA, 225 bp, Artificial Sequence; identical to SEQ ID NO: 95239
  Description of Artificial Sequence: Synthetic coding sequence

SEQ ID NO: 95248 - DNA, 225 bp, Artificial Sequence; identical to SEQ ID NO: 95239
  Description of Artificial Sequence: Synthetic coding sequence

SEQ ID NO: 95249 - DNA, 225 bp, Artificial Sequence; identical to SEQ ID NO: 95239
  Description of Artificial Sequence: Synthetic coding sequence

SEQ ID NO: 95250 - DNA, 225 bp, Artificial Sequence; identical to SEQ ID NO: 95239
  Description of Artificial Sequence: Synthetic coding sequence

SEQ ID NO: 95251 - DNA, 225 bp, Artificial Sequence; identical to SEQ ID NO: 95239
  Description of Artificial Sequence: Synthetic coding sequence

SEQ ID NO: 95252 - DNA, 225 bp, Artificial Sequence; identical to SEQ ID NO: 95239
  Description of Artificial Sequence: Synthetic coding sequence

SEQ ID NO: 95253 - DNA, 225 bp, Artificial Sequence; identical to SEQ ID NO: 95239
  Description of Artificial Sequence: Synthetic coding sequence

SEQ ID NO: 95254 - DNA, 225 bp, Artificial Sequence; identical to SEQ ID NO: 95239
  Description of Artificial Sequence: Synthetic coding sequence

SEQ ID NO: 95255 - DNA, 225 bp, Artificial Sequence; identical to SEQ ID NO: 95239
  Description of Artificial Sequence: Synthetic coding sequence

SEQ ID NO: 95256 - DNA, 225 bp, Artificial Sequence; identical to SEQ ID NO: 95239
  Description of Artificial Sequence: Synthetic coding sequence

SEQ ID NO: 95257 - DNA, 225 bp, Artificial Sequence; identical to SEQ ID NO: 95239
  Description of Artificial Sequence: Synthetic coding sequence

SEQ ID NO: 95258 - DNA, 225 bp, Artificial Sequence; identical to SEQ ID NO: 95239
  Description of Artificial Sequence: Synthetic coding sequence

SEQ ID NO: 95259 - DNA, 225 bp, Artificial Sequence; identical to SEQ ID NO: 95239
  Description of Artificial Sequence: Synthetic coding sequence

SEQ ID NO: 95260 - DNA, 225 bp, Artificial Sequence; identical to SEQ ID NO: 95239
  Description of Artificial Sequence: Synthetic coding sequence

SEQ ID NO: 95261 - DNA, 381 bp, Artificial Sequence; identical to SEQ ID NO: 95243
  Description of Artificial Sequence: Synthetic coding sequence

SEQ ID NO: 95262 - DNA, 381 bp, Artificial Sequence; identical to SEQ ID NO: 95243
  Description of Artificial Sequence: Synthetic coding sequence

SEQ ID NO: 95263 - DNA, 225 bp, Artificial Sequence; identical to SEQ ID NO: 95239
  Description of Artificial Sequence: Synthetic coding sequence

SEQ ID NO: 95264 - DNA, 225 bp, Artificial Sequence; identical to SEQ ID NO: 95239
  Description of Artificial Sequence: Synthetic coding sequence

SEQ ID NO: 95265 - DNA, 225 bp, Artificial Sequence; identical to SEQ ID NO: 95239
  Description of Artificial Sequence: Synthetic coding sequence

SEQ ID NO: 95266 - DNA, 381 bp, Artificial Sequence; identical to SEQ ID NO: 95243
  Description of Artificial Sequence: Synthetic coding sequence

SEQ ID NO: 95267 - DNA, 225 bp, Artificial Sequence; identical to SEQ ID NO: 95239
  Description of Artificial Sequence: Synthetic coding sequence

SEQ ID NO: 95268 - DNA, 225 bp, Artificial Sequence; identical to SEQ ID NO: 95239
  Description of Artificial Sequence: Synthetic coding sequence

SEQ ID NO: 95269 - DNA, 381 bp, Artificial Sequence; identical to SEQ ID NO: 95243
  Description of Artificial Sequence: Synthetic coding sequence

SEQ ID NO: 95270 - DNA, 225 bp, Artificial Sequence; identical to SEQ ID NO: 95239
  Description of Artificial Sequence: Synthetic coding sequence

SEQ ID NO: 95271 - DNA, 225 bp, Artificial Sequence; identical to SEQ ID NO: 95239
  Description of Artificial Sequence: Synthetic coding sequence

SEQ ID NO: 95272 - DNA, 225 bp, Artificial Sequence; identical to SEQ ID NO: 95239
  Description of Artificial Sequence: Synthetic coding sequence

SEQ ID NO: 95273 - DNA, 225 bp, Artificial Sequence; identical to SEQ ID NO: 95239
  Description of Artificial Sequence: Synthetic coding sequence

SEQ ID NO: 95274 - DNA, 225 bp, Artificial Sequence; identical to SEQ ID NO: 95239
  Description of Artificial Sequence: Synthetic coding sequence

SEQ ID NO: 95275 - DNA, 225 bp, Artificial Sequence; identical to SEQ ID NO: 95239
  Description of Artificial Sequence: Synthetic coding sequence

SEQ ID NO: 95276 - DNA, 381 bp, Artificial Sequence; identical to SEQ ID NO: 95243
  Description of Artificial Sequence: Synthetic coding sequence

SEQ ID NO: 95277 - DNA, 225 bp, Artificial Sequence; identical to SEQ ID NO: 95239
  Description of Artificial Sequence: Synthetic coding sequence

SEQ ID NO: 95278 - DNA, 225 bp, Artificial Sequence; identical to SEQ ID NO: 95239
  Description of Artificial Sequence: Synthetic coding sequence

SEQ ID NO: 95279 - DNA, 225 bp, Artificial Sequence; identical to SEQ ID NO: 95239
  Description of Artificial Sequence: Synthetic coding sequence

SEQ ID NO: 95280 - DNA, 225 bp, Artificial Sequence; identical to SEQ ID NO: 95239
  Description of Artificial Sequence: Synthetic coding sequence

SEQ ID NO: 95281 - DNA, 225 bp, Artificial Sequence; identical to SEQ ID NO: 95239
  Description of Artificial Sequence: Synthetic coding sequence

SEQ ID NO: 95282 - DNA, 225 bp, Artificial Sequence; identical to SEQ ID NO: 95239
  Description of Artificial Sequence: Synthetic coding sequence

SEQ ID NO: 95283 - DNA, 381 bp, Artificial Sequence; identical to SEQ ID NO: 95243
  Description of Artificial Sequence: Synthetic coding sequence

SEQ ID NO: 95284 - DNA, 225 bp, Artificial Sequence; identical to SEQ ID NO: 95239
  Description of Artificial Sequence: Synthetic coding sequence

SEQ ID NO: 95285 - DNA, 225 bp, Artificial Sequence; identical to SEQ ID NO: 95239
  Description of Artificial Sequence: Synthetic coding sequence

SEQ ID NO: 95286 - DNA, 225 bp, Artificial Sequence; identical to SEQ ID NO: 95239
  Description of Artificial Sequence: Synthetic coding sequence

SEQ ID NO: 95287 - DNA, 444 bp, Artificial Sequence
  Description of Artificial Sequence: Synthetic coding sequence
atggccgacagcggcaccgccggcggcgccgccctggccgcccccgcccccggccccggcagcggcggccccggccccagagtgtacttccagagcccccccggcgccgccggcgagggccccggcggcgccgacgacgagggccccgtgagaagacagggcaaggtgaccgtgaagtacgacagaaaggagctgagaaagagactgaacctggaggagtggatcctggagcagctgaccagactgtacgactgccaggaggaggagatccccgagctggagatcgacgtggacgagctgctggacatggagagcgacgacgccagagccgccagagtgaaggagctgctggtggactgctacaagcccaccgaggccttcatcagcggcctgctggacaagatcagaggcatgcagaagctgagcaccccccagaagaagtag

SEQ ID NO: 95288 - DNA, 498 bp, Artificial Sequence
  Description of Artificial Sequence: Synthetic coding sequence
atgagcgtggccaccggcagcagcgagaccgccggcggcgccagcggcggcggcgccagagtgttcttccagagccccagaggcggcgccggcggcagccccggcagcagcagcggcagcggcagcagcagagaggacagcgcccccgtggccaccgccgccgccgccggccaggtgcagcagcagcagcagagaagacaccagcagggcaaggtgaccgtgaagtacgacagaaaggagctgagaaagagactggtgctggaggagtggatcgtggagcagctgggccagctgtacggctgcgaggaggaggagatgcccgaggtggagatcgacatcgacgacctgctggacgccgacagcgacgaggagagagccagcaagctgcaggaggccctggtggactgctacaagcccaccgaggagttcatcaaggagctgctgagcagaatcagaggcatgagaaagctgagccccccccagaagaagagcgtgtag

SEQ ID NO: 95289 - DNA, 438 bp, Artificial Sequence
  Description of Artificial Sequence: Synthetic coding sequence
atgctgagcagcagccccgccagctgcaccagccccagccccgacggcgagaacccctgcaagaaggtgcactgggccagcggcagaagaagaaccagcagcaccgacagcgagagcaagagccaccccgacagcagcaagatccccagaagcagaagacccagcagactgaccgtgaagtacgacagaggccagctgcagagatggctggagatggagcagtgggtggacgcccaggtgcaggagctgttccaggaccaggccacccccagcgagcccgagatcgacctggaggccctgatggacctgagcaccgaggagcagaagacccagctggaggccatcctgggcaactgccccagacccaccgaggccttcatcagcgagctgctgagccagctgaagaagctgagaagactgagcagaccccagaagtag

SEQ ID NO: 95290 - DNA, 603 bp, Artificial Sequence
  Description of Artificial Sequence: Synthetic coding sequence
atgctgagcagcagccccgccagctgcaccagccccagccccgacggcgagaacccctgcaagaaggtgcactgggccagcggcagaagaagaaccagcagcaccgacagcgagagcaagagccaccccgacagcagcaagatccccagaagcagaagacccagcagactgaccgtgaagtacgacagaggccagctgcagagatggctggagatggagcagtgggtggacgcccaggtgcaggagctgttccagagcctggccctgagccccagactggagtgcagcggcgtgatccacagcctgcagctgctgccccccggcttcaacagattcagctgcctgagcagctggagcagctgggactacggcatcaagcagcccctgctgagcctgagactgacctggaagctgagctggatctacccccagagaagcagaagactgagctggagacccttcctgggcaccgcccccgccccccagagactgctgagcctgagctgcagcgtgaacagcagaaacagcggcgacagcgccggcctgagaaacaagcccgagagacccagcctggccgccagcgccctgcccggcctgccctag

SEQ ID NO: 95291 - DNA, 516 bp, Artificial Sequence
  Description of Artificial Sequence: Synthetic coding sequence
atggagcaggacaacagccccagaaagatccagttcaccgtgcccctgctggagccccacctggaccccgaggccgccgagcagatcagaagaagaagacccacccccgccaccctggtgctgaccagcgaccagagcagccccgagatcgacgaggacagaatccccaacccccacctgaagagcaccctggccatgagccccagacagagaaagaagatgaccagaatcacccccaccatgaaggagctgcagatgatggtggagcaccacctgggccagcagcagcagggcgaggagcccgagggcgccgccgagagcaccgagacccaggagagcagaccccccggcatccccgacaccgaggtggagagcagactgggcaccagcggcaccgccaagaagaccgccgagtgcatccccaagacccacgagagaggcagcaaggagcccagcaccaaggagcccagcacccacatcccccccctggacagcaagggcgccaacagcgtgtag

SEQ ID NO: 95292 - DNA, 462 bp, Artificial Sequence
  Description of Artificial Sequence: Synthetic coding sequence
atggagcaggacaacagccccagaaagatccagttcaccgtgcccctgctggagccccacctggaccccgaggccgccgagcagatcagaagaagaagacccacccccgccaccctggtgctgaccagcgaccagagcagccccgagatcgacgaggacagaatccccaacccccacctgaagaagctgcagaacgccagcctgaagctgaccagagaggccgtgagaaaccccgcccagaagaacccccagcccatctaccaccactggatccccagagagcccaccagatgccacagaagaggcggcaccggcggccagaagagcgtgggcggcttcccctgcagcacccacaccctggcccccttctacgtgttcaccagaagcatcctgctgctgaagagaggcgagagaatgagccaccccctggagcccagagacgaccccaccaagatgccctag

SEQ ID NO: 95293 - DNA, 330 bp, Artificial Sequence
  Description of Artificial Sequence: Synthetic coding sequence
atggagcccaacagccccaagaagatccagttcgccgtgcccgtgttccagagccagatcgcccccgaggccgccgagcagatcagaaagagaagacccacccccgccagcctggtgatcctgaacgagcacaacccccccgagatcgacgacaagagaggccccaacacccagggcgagctgcagaacgccagccccaagcagagaaagcagagcgtgtacaccccccccaccatcaagggcgtgaagcacctgaagggccagaacgagagcgccttccccgaggaggaggagggcaccaacgagagagaggagcagagagaccactag

SEQ ID NO: 95294 - DNA, 330 bp, Artificial Sequence; identical to SEQ ID NO: 95293
  Description of Artificial Sequence: Synthetic coding sequence

SEQ ID NO: 95295 - DNA, 330 bp, Artificial Sequence; identical to SEQ ID NO: 95293
  Description of Artificial Sequence: Synthetic coding sequence

SEQ ID NO: 95296 - DNA, 618 bp, Artificial Sequence
  Description of Artificial Sequence: Synthetic coding sequence
atggccgccagcaccgccagccacagacccatcaagggcatcctgaagaacaagaccagcaccaccagcagcatggtggccagcgccgagcagcccagaggcaacgtggacgaggagctgagcaagaagagccagaagtgggacgagatgaacatcctggccacctaccaccccgccgacaaggactacggcctgatgaagatcgacgagcccagcaccccctaccacagcatgatgggcgacgacgaggacgcctgcagcgacaccgaggccaccgaggccatggcccccgacatcctggccagaaagctggccgccgccgagggcctggagcccaagtacagaatccaggagcaggagagcagcggcgaggaggacagcgacctgagccccgaggagagagagaagaagagacagttcgagatgaagagaaagctgcactacaacgagggcctgaacatcaagctggccagacagctgatcagcaaggacctgcacgacgacgacgaggacgaggagatgctggagaccgccgacggcgagagcatgaacaccgaggagagcaaccagggcagcacccccagcgaccagcagcagaacaagctgagaagcagctag

SEQ ID NO: 95297 - DNA, 3093 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccagaccgacagcatcagcagatacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95298 - DNA, 2916 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccaggtgaacaccatcaccctgtacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95299 - DNA, 2925 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccaggtgaacaccatcaccctgtacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95300 - DNA, 2988 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccaggtgaacaccatcaccctgtacgagaccagcagcaccagcgccggcgacagatacgacagcctgctgggcagaagcggcagctacagctacctggaggagagaaagccctacagcagcagactggagaaggacgacagcaccgacttcaagaagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95301 - DNA, 2988 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccagaccgacagcatcagcagatacgagaccagcagcaccagcgccggcgacagatacgacagcctgctgggcagaagcggcagctacagctacctggaggagagaaagccctacagcagcagactggagaaggacgacagcaccgacttcaagaagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95302 - DNA, 3093 bp, Artificial Sequence; identical to SEQ ID NO: 95297
  Description of Artificial Sequence: Synthetic coding sequence

SEQ ID NO: 95303 - DNA, 3093 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccaggtgaacaccatcaccctgtacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95304 - DNA, 2832 bp, Artificial Sequence
  Description of Artificial Sequence: Synthetic coding sequence
atggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagctgcagcttcggcagaagacaggacgacctgatcagcagcagcgtgcccagcaccaccagcacccccaccgtgaccagcgccgccggcctgcagaagagcctgctgagcagcaccagcaccaccaccaagatcaccaccggcagcagcagcgccggcacccagagcagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccagaccgacagcatcagcagatacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95305 - DNA, 2925 bp, Artificial Sequence
  Description of Artificial Sequence: Synthetic coding sequence
atgaagatggccgacgccaagcagaagagaaacgagcagctgaagagatggatcggcagcgagaccgacctggagccccccgtggtgaagagacagaagaccaaggtgaagttcgacgacggcgccgtgttcctggccgcctgcagcagcggcgacaccgacgaggtgctgaagctgctgcacagaggcgccgacatcaactacgccaacgtggacggcctgaccgccctgcaccaggcctgcatcgacgacaacgtggacatggtgaagttcctggtggagaacggcgccaacatcaaccagcccgacaacgagggctggatccccctgcacgccgccgccagctgcggctacctggacatcgccgagttcctgatcggccagggcgcccacgtgggcgccgtgaacagcgagggcgacacccccctggacatcgccgaggaggaggccatggaggagctgctgcagaacgaggtgaacagacagggcgtggacatcgaggccgccagaaaggaggaggagagaatcatgctgagagacgccagacagtggctgaacagcggccacatcaacgacgtgagacacgccaagagcggcggcaccgccctgcacgtggccgccgccaagggctacaccgaggtgctgaagctgctgatccaggccggctacgacgtgaacatcaaggactacgacggctggacccccctgcacgccgccgcccactggggcaaggaggaggcctgcagaatcctggtggacaacctgtgcgacatggagatggtgaacaaggtgggccagaccgccttcgacgtggccgacgaggacatcctgggctacctggaggagctgcagaagaagcagaacctgctgcacagcgagaagagagacaagaagagccccctgatcgagagcaccgccaacatggacaacaaccagagccagaagaccttcaagaacaaggagaccctgatcatcgagcccgagaagaacgccagcagaatcgagagcctggagcaggagaaggtggacgaggaggaggagggcaagaaggacgagagcagctgcagcagcgaggaggacgaggaggacgacagcgagagcgaggccgagaccgacaagaccaagcccctggccagcgtgaccaacgccaacaccagcagcacccaggccgcccccgtggccgtgaccacccccaccgtgagcagcggccaggccacccccaccagccccatcaagaagttccccaccaccgccaccaagatcagccccaaggaggaggagagaaaggacgagagccccgccacctggagactgggcctgagaaagaccggcagctacggcgccctggccgagatcaccgccagcaaggagggccagaaggagaaggacaccgccggcgtgaccagaagcgccagcagccccagactgagcagcagcctggacaacaaggagaaggagaaggacagcaagggcaccagactggcctacgtggcccccaccatccccagaagactggccagcaccagcgacatcgaggagaaggagaacagagacagcagcagcctgagaaccagcagcagctacaccagaagaaagtgggaggacgacctgaagaagaacagcagcgtgaacgagggcagcacctaccacaagagcaccagcaacagactgtgggccgaggacagcaccgagaaggagaaggacagcgtgcccaccgccgtgaccatccccgtggcccccaccgtggtgaacgccgccgccagcaccaccaccctgaccaccaccaccgccggcaccgtgagcagcaccaccgaggtgagagagagaagaagaagctacctgacccccgtgagagacgaggagagcgagagccagagaaaggccagaagcagacaggccagacagagcagaagaagcacccagggcgtgaccctgaccgacctgcaggaggccgagaagaccatcggcagaagcagaagcaccagaaccagagagcaggagaacgaggagaaggagaaggaggagaaggagaagcaggacaaggagaagcaggaggagaagaaggagagcgagaccagcagagaggacgagtacaagcagaagtacagcagaacctacgacgagacctaccagagatacagacccgtgagcaccagcagcagcaccacccccagcagcagcctgagcaccatgagcagcagcctgtacgccagcagccagctgaacagacccaacagcctggtgggcatcaccagcgcctacagcagaggcatcaccaaggagaacgagagagagggcgagaagagagaggaggagaaggagggcgaggacaagagccagcccaagagcatcagagagagaagaagacccagagagaagagaagaagcaccggcgtgagcttctggacccaggacagcgacgagaacgagcaggagcagcagagcgacaccgaggagggcagcaacaagaaggagacccagaccgacagcatcagcagatacgagaccagcagcaccagcgccggcgacagatacgacagcctgctgggcagaagcggcagctacagctacctggaggagagaaagccctacagcagcagactggagaaggacgacagcaccgacttcaagaagctgtacgagcagatcctggccgagaacgagaagctgaaggcccagctgcacgacaccaacatggagctgaccgacctgaagctgcagctggagaaggccacccagagacaggagagattcgccgacagaagcctgctggagatggagaagagagagagaagagccctggagagaagaatcagcgagatggaggaggagctgaagatgctgcccgacctgaaggccgacaaccagagactgaaggacgagaacggcgccctgatcagagtgatcagcaagctgagcaagtag

SEQ ID NO: 95306 - DNA, 2949 bp, Artificial Sequence
  Description of Artificial Sequence: Synthetic coding sequence
atggccgagctggagcacctgggcggcaagagagccgagagcgccagaatgagaagagccgagcagctgagaagatggagaggcagcctgaccgagcaggagcccgccgagagaagaggcgccggcagacagcccctgaccagaagaggcagccccagagtgagattcgaggacggcgccgtgttcctggccgcctgcagcagcggcgacaccgacgaggtgagaaagctgctggccagaggcgccgacatcaacaccgtgaacgtggacggcctgaccgccctgcaccaggcctgcatcgacgagaacctggacatggtgaagttcctggtggagaacagagccaacgtgaaccagcaggacaacgagggctggacccccctgcacgccgccgccagctgcggctacctgaacatcgccgagtacttcatcaaccacggcgccagcgtgggcatcgtgaacagcgagggcgaggtgcccagcgacctggccgaggagcccgccatgaaggacctgctgctggagcaggtgaagaagcagggcgtggacctggagcagagcagaaaggaggaggagcagcagatgctgcaggacgccagacagtggctgaacagcggcaagatcgaggacgtgagacaggccagaagcggcgccaccgccctgcacgtggccgccgccaagggctacagcgaggtgctgagactgctgatccaggccggctacgagctgaacgtgcaggactacgacggctggacccccctgcacgccgccgcccactggggcgtgaaggaggcctgcagcatcctggccgaggccctgtgcgacatggacatcagaaacaagctgggccagacccccttcgacgtggccgacgagggcctggtggagcacctggagctgctgcagaagaagcagaacgtgctgagaagcgagaaggagaccagaaacaagctgatcgagagcgacctgaacagcaagatccagagcggcttcttcaagaacaaggagaagatgctgtacgaggaggagacccccaagagccaggagatggaggaggagaacaaggagagcagcagcagcagcagcgaggaggaggagggcgaggacgaggccagcgagagcgagaccgagaaggaggccgacaagaagcccgaggccttcgtgaaccacagcaacagcgagagcaagagcagcatcaccgagcagatccccgcccccgcccagaacaccttcagcgccagcagcgccagaagattcagcagcggcctgttcaacaagcccgaggagcccaaggacgagagccccagcagctggagactgggcctgagaaagaccggcagccacaacatgctgagcgaggtggccaacagcagagagcccatcagagacagaggcagcagcatctacagaagcagcagcagccccagaatcagcgccctgctggacaacaaggacaaggagagagagaacaagagctacatcagcagcctggcccccagaaagctgaacagcaccagcgacatcgaggagaaggagaacagagagagcgccgtgaacctggtgagaagcggcagctacaccagacagctgtggagagacgaggccaagggcaacgagatcccccagaccatcgcccccagcacctacgtgagcacctacctgaagagaaccccccacaagagccaggccgacaccaccgccgagaagaccgccgacaacgtgagcagcagcacccccctgtgcgtgatcaccaacagacccctgcccagcaccgccaacggcgtgaccgccacccccgtgctgagcatcaccggcaccgacagcagcgtggaggccagagagaagagaagaagctacctgacccccgtgagagacgaggaggccgagagcctgagaaaggccagaagcagacaggccagacagaccagaagaagcacccagggcgtgaccctgaccgacctgcaggaggccgagagaaccttcagcagaagcagagccgagagacaggcccaggagcagcccagagagaagcccaccgacaccgagggcctggagggcagccccgagaagcacgagcccagcgccgtgcccgccaccgaggccggcgagggccagcagccctggggcagaagcctggacgaggagcccatctgccacagactgagatgccccgcccagcccgacaagcccaccacccccgccagccccagcaccagcagacccagcctgtacaccagcagccacctgctgtggaccaacagattcagcgtgcccgacagcgagagcagcgagaccaccaccaacaccaccaccgccaaggagatggacaagaacgagaacgaggaggccgacctggacgagcagagcagcaagagactgagcatcagagagagaagaagacccaaggagagaagaagaggcaccggcatcaacttctggaccaaggacgaggacgagaccgacggcagcgaggaggtgaaggagacctgggccgagagactgaagagactggagagcggcggcagcaaccccaccaccagcgacagctacggcgacagagccagcgccagagccagaagagaggccagagaggccagactggccaccctgaccagcagagtggaggaggacagcaacagagactacaagaagctgtacgagagcgccctgaccgagaaccagaagctgaagaccaagctgcaggaggcccagctggagctggccgacatcaagagcaagctggagaaggtggcccagcagaagcaggagaagaccagcgacagaagcagcgtgctggagatggagaagagagagagaagagccctggagagaaagatgagcgagatggaggaggagatgaaggtgctgaccgagctgaagagcgacaaccagagactgaaggacgagaacggcgccctgatcagagtgatcagcaagctgagcaagtag

SEQ ID NO: 95307 - DNA, 1161 bp, Artificial Sequence
  Description of Artificial Sequence: Synthetic coding sequence
atggccgagctggagcacctgggcggcaagagagccgagagcgccagaatgagaagagccgagcagctgagaagatggagaggcagcctgaccgagcaggagcccgccgagagaagaggcgccggcagacagcccctgaccagaagaggcagccccagagtgagattcgaggacggcgccgtgttcctggccgcctgcagcagcggcgacaccgacgaggtgagaaagctgctggccagaggcgccgacatcaacaccgtgaacgtggacggcctgaccgccctgcaccaggcctgcatcgacgagaacctggacatggtgaagttcctggtggagaacagagccaacgtgaaccagcaggacaacgagggctggacccccctgcacgccgccgccagctgcggctacctgaacatcgccgagtacttcatcaaccacggcgccagcgtgggcatcgtgaacagcgagggcgaggtgcccagcgacctggccgaggagcccgccatgaaggacctgctgctggagcaggtgaagaagcagggcgtggacctggagcagagcagaaaggaggaggagcagcagatgctgcaggacgccagacagtggctgaacagcggcaagatcgaggacgtgagacaggccagaagcggcgccaccgccctgcacgtggccgccgccaagggctacagcgaggtgctgagactgctgatccaggccggctacgagctgaacgtgcaggactacgacggctggacccccctgcacgccgccgcccactggggcgtgaaggaggcctgcagcatcctggccgaggccctgtgcgacatggacatcagaaacaagctgggccagacccccttcgacgtggccgacgagggcctggtggagcacctggagctgctgcagaagaagcagaacgtgctgagaagcgagaaggagaccagaaacaagctgatcgagagcgacctgaacagcaagatccagagcggcttcttcaagaacaaggagaagatgctgtacgaggaggagacccccaagagccaggagatggaggaggagaacaaggagagcagcagcagcagcagcgaggaggaggagggcgaggacgaggccagcgagagcgagaccgagaaggaggccgtgctgttctggcccttctag

SEQ ID NO: 95308 - DNA, 675 bp, Artificial Sequence
  Description of Artificial Sequence: Synthetic coding sequence
atggacaagaacgagaacgaggaggccgacctggacgagcagagcagcaagagactgagcatcagagagagaagaagacccaaggagagaagaagaggcaccggcatcaacttctggaccaaggacgaggacgagaccgacggcagcgaggaggtgaaggagacctggcacgagagactgagcagactggagagcggcggcagcaaccccaccaccagcgacagctacggcgacagagccagcgccagagccagaagagaggccagagaggccagactggccaccctgaccagcagagtggaggaggacagcaacagagactacaagaagctgtacgagagcgccctgaccgagaaccagaagctgaagaccaagctgcaggaggcccagctggagctggccgacatcaagagcaagctggagaaggtggcccagcagaagcaggagaagaccagcgacagaagcagcgtgctggagatggagaagagagagagaagagccctggagagaaagatgagcgagatggaggaggagatgaagaacctgcaccagctgaagcagatccagaccctgaagcagatgaacgagcagctgcaggccgagaacagagccctgaccagagtggtggccagactgagcgagagcatcgagagcagcgacacccaggagctgtag

SEQ ID NO: 95309 - DNA, 627 bp, Artificial Sequence
  Description of Artificial Sequence: Synthetic coding sequence
atggacaagaacgagaacgaggaggccgacctggacgagcagagcagcaagagactgagcatcagagagagaagaagacccaaggagagaagaagaggcaccggcatcaacttctggaccaaggacgaggacgagaccgacggcagcgaggaggtgaaggagacctggcacgagagactgagcagactggagagcggcggcagcaaccccaccaccagcgacagctacggcgacagagccagcgccagagccagaagagaggccagagaggccagactggccaccctgaccagcagagtggaggaggacagcaacagagactacaagaagctgtacgagagcgccctgaccgagaaccagaagctgaagaccaagctgcaggaggcccagctggagctggccgacatcaagagcaagctggagaaggtggcccagcagaagcaggagaagaccagcgacagaagcagcgtgctggagatggagaagagagagagaagagccctggagagaaagatgagcgagatggaggaggagatgaaggtgctgaccgagctgaagagcgacaaccagagactgaaggacgagaacggcgccctgatcagagtgatcagcaagctgagcaagtag

SEQ ID NO: 95310 - DNA, 2949 bp, Artificial Sequence
  Description of Artificial Sequence: Synthetic coding sequence
atggccgagctggagcacctgggcggcaagagagccgagagcgccagaatgagaagagccgagcagctgagaagatggagaggcagcctgaccgagcaggagcccgccgagagaagaggcgccggcagacagcccctgaccagaagaggcagccccagagtgagattcgaggacggcgccgtgttcctggccgcctgcagcagcggcgacaccgacgaggtgagaaagctgctggccagaggcgccgacatcaacaccgtgaacgtggacggcctgaccgccctgcaccaggcctgcatcgacgagaacctggacatggtgaagttcctggtggagaacagagccaacgtgaaccagcaggacaacgagggctggacccccctgcacgccgccgccagctgcggctacctgaacatcgccgagtacttcatcaaccacggcgccagcgtgggcatcgtgaacagcgagggcgaggtgcccagcgacctggccgaggagcccgccatgaaggacctgctgctggagcaggtgaagaagcagggcgtggacctggagcagagcagaaaggaggaggagcagcagatgctgcaggacgccagacagtggctgaacagcggcaagatcgaggacgtgagacaggccagaagcggcgccaccgccctgcacgtggccgccgccaagggctacagcgaggtgctgagactgctgatccaggccggctacgagctgaacgtgcaggactacgacggctggacccccctgcacgccgccgcccactggggcgtgaaggaggcctgcagcatcctggccgaggccctgtgcgacatggacatcagaaacaagctgggccagacccccttcgacgtggccgacgagggcctggtggagcacctggagctgctgcagaagaagcagaacgtgctgagaagcgagaaggagaccagaaacaagctgatcgagagcgacctgaacagcaagatccagagcggcttcttcaagaacaaggagaagatgctgtacgaggaggagacccccaagagccaggagatggaggaggagaacaaggagagcagcagcagcagcagcgaggaggaggagggcgaggacgaggccagcgagagcgagaccgagaaggaggccgacaagaagcccgaggccttcgtgaaccacagcaacagcgagagcaagagcagcatcaccgagcagatccccgcccccgcccagaacaccttcagcgccagcagcgccagaagattcagcagcggcctgttcaacaagcccgaggagcccaaggacgagagccccagcagctggagactgggcctgagaaagaccggcagccacaacatgctgagcgaggtggccaacagcagagagcccatcagagacagaggcagcagcatctacagaagcagcagcagccccagaatcagcgccctgctggacaacaaggacaaggagagagagaacaagagctacatcagcagcctggcccccagaaagctgaacagcaccagcgacatcgaggagaaggagaacagagagagcgccgtgaacctggtgagaagcggcagctacaccagacagctgtggagagacgaggccaagggcaacgagatcccccagaccatcgcccccagcacctacgtgagcacctacctgaagagaaccccccacaagagccaggccgacaccaccgccgagaagaccgccgacaacgtgagcagcagcacccccctgtgcgtgatcaccaacagacccctgcccagcaccgccaacggcgtgaccgccacccccgtgctgagcatcaccggcaccgacagcagcgtggaggccagagagaagagaagaagctacctgacccccgtgagagacgaggaggccgagagcctgagaaaggccagaagcagacaggccagacagaccagaagaagcacccagggcgtgaccctgaccgacctgcaggaggccgagagaaccttcagcagaagcagagccgagagacaggcccaggagcagcccagagagaagcccaccgacaccgagggcctggagggcagccccgagaagcacgagcccagcgccgtgcccgccaccgaggccggcgagggccagcagccctggggcagaagcctggacgaggagcccatctgccacagactgagatgccccgcccagcccgacaagcccaccacccccgccagccccagcaccagcagacccagcctgtacaccagcagccacctgctgtggaccaacagattcagcgtgcccgacagcgagagcagcgagaccaccaccaacaccaccaccgccaaggagatggacaagaacgagaacgaggaggccgacctggacgagcagagcagcaagagactgagcatcagagagagaagaagacccaaggagagaagaagaggcaccggcatcaacttctggaccaaggacgaggacgagaccgacggcagcgaggaggtgaaggagacctggcacgagagactgagcagactggagagcggcggcagcaaccccaccaccagcgacagctacggcgacagagccagcgccagagccagaagagaggccagagaggccagactggccaccctgaccagcagagtggaggaggacagcaacagagactacaagaagctgtacgagagcgccctgaccgagaaccagaagctgaagaccaagctgcaggaggcccagctggagctggccgacatcaagagcaagctggagaaggtggcccagcagaagcaggagaagaccagcgacagaagcagcgtgctggagatggagaagagagagagaagagccctggagagaaagatgagcgagatggaggaggagatgaaggtgctgaccgagctgaagagcgacaaccagagactgaaggacgagaacggcgccctgatcagagtgatcagcaagctgagcaagtag

SEQ ID NO: 95311 - DNA, 2349 bp, Artificial Sequence
  Description of Artificial Sequence: Synthetic coding sequence
atgagcggcgaggacggccccgccgccggccccggcgccgccgccgccgccgccagagagagaagaagagagcagctgagacagtggggcgccagagccggcgccgagcccggccccggcgagagaagagccagaaccgtgagattcgagagagccgccgagttcctggccgcctgcgccggcggcgacctggacgaggccagactgatgctgagagccgccgaccccggccccggcgccgagctggaccccgccgcccccccccccgccagagccgtgctggacagcaccaacgccgacggcatcagcgccctgcaccaggcctgcatcgacgagaacctggaggtggtgagattcctggtggagcagggcgccaccgtgaaccaggccgacaacgagggctggacccccctgcacgtggccgccagctgcggctacctggacatcgccagatacctgctgagccacggcgccaacatcgccgccgtgaacagcgacggcgacctgcccctggacctggccgagagcgacgccatggagggcctgctgaaggccgagatcgccagaagaggcgtggacgtggaggccgccaagagagccgaggaggagctgctgctgcacgacaccagatgctggctgaacggcggcgccatgcccgaggccagacaccccagaaccggcgccagcgccctgcacgtggccgccgccaagggctacatcgaggtgatgagactgctgctgcaggccggctacgaccccgagctgagagacggcgacggctggacccccctgcacgccgccgcccactggggcgtggaggacgcctgcagactgctggccgagcacggcggcggcatggacagcctgacccacgccggccagagaccctgcgacctggccgacgaggaggtgctgagcctgctggaggagctggccagaaagcaggaggacctgagaaaccagaaggaggccagccagagcagaggccaggagccccaggcccccagcagcagcaagcacagaagaagcagcgtgtgcagactgagcagcagagagaagatcagcctgcaggacctgagcaaggagagaagacccggcggcgccggcggcccccccatccaggacgaggacgagggcgaggagggccccaccgagcccccccccgccgagcccagaaccctgaacggcgtgagcagccccccccaccccagccccaagagccccgtgcagctggaggaggcccccttcagcagaagattcggcctgctgaagaccggcagcagcggcgccctgggcccccccgagagaagaaccgccgagggcgcccccggcgccggcctgcagagaagcgccagcagcagctggctggagggcaccagcacccaggccaaggagctgagactggccagaatcacccccacccccagccccaagctgcccgagcccagcgtgctgagcgaggtgaccaagccccccccctgcctggagaacagcagcccccccagcagaatccccgagcccgagagccccgccaagcccaacgtgcccaccgccagcaccgccccccccgccgacagcagagacagaagaagaagctaccagatgcccgtgagagacgaggagagcgagagccagagaaaggccagaagcagactgatgagacagagcagaagaagcacccagggcgtgaccctgaccgacctgaaggaggccgagaaggccgccggcaaggcccccgagagcgagaagcccgcccagagcctggaccccagcagaagacccagagtgcccggcgtggagaacagcgacagccccgcccagagagccgaggcccccgacggccagggccccggcccccaggccgccagagagcacagaaaggtgggcaaggagtggagaggccccgccgagggcgaggaggccgagcccgccgacagaagccaggagagcagcaccctggagggcggccccagcgccagaagacagagatggcagagagacctgaaccccgagcccgagcccgagagcgaggagcccgacggcggcttcagaaccctgtacgccgagctgagaagagagaacgagagactgagagaggccctgaccgagaccaccctgagactggcccagctgaaggtggagctggagagagccacccagagacaggagagattcgccgagagacccgccctgctggagctggagagattcgagagaagagccctggagagaaaggccgccgagctggaggaggagctgaaggccctgagcgacctgagagccgacaaccagagactgaaggacgagaacgccgccctgatcagagtgatcagcaagctgagcaagtag

SEQ ID NO: 95312 - DNA, 2160 bp, Artificial Sequence
  Description of Artificial Sequence: Synthetic coding sequence
atgagcggcgaggacggccccgccgccggccccggcgccgccgccgccgccgccagagagagaagaagagagcagctgagacagtggggcgccagagccggcgccgagcccggccccggcgagagaagagccagaaccgtgagattcgagagagccgccgagttcctggccgcctgcgccggcggcgacctggacgaggccagactgatgctgagagccgccgaccccggccccggcgccgagctggaccccgccgcccccccccccgccagagccgtgctggacagcaccaacgccgacggcatcagcgccctgcaccaggcctgcatcgacgagaacctggaggtggtgagattcctggtggagcagggcgccaccgtgaaccaggccgacaacgagggctggacccccctgcacgtggccgccagctgcggctacctggacatcgccagatacctgctgagccacggcgccaacatcgccgccgtgaacagcgacggcgacctgcccctggacctggccgagagcgacgccatggagggcctgctgaaggccgagatcgccagaagaggcgtggacgtggaggccgccaagagagccgaggaggagctgctgctgcacgacaccagatgctggctgaacggcggcgccatgcccgaggccagacaccccagaaccggcgccagcgccctgcacgtggccgccgccaagggctacatcgaggtgatgagactgctgctgcaggccggctacgaccccgagctgagagacggcgacggctggacccccctgcacgccgccgcccactggggcgtggaggacgcctgcagactgctggccgagcacggcggcggcatggacagcctgacccacgccggccagagaccctgcgacctggccgacgaggaggtgctgagcctgctggaggagctggccagaaagcaggaggacctgagaaaccagaaggaggccagccagagcagaggccaggagccccaggcccccagcagcagcaagcacagaagaagcagcgtgtgcagactgagcagcagagagaagatcagcctgcaggacctgagcaaggagagaagacccggcggcgccggcggcccccccatccaggacgaggacgagggcgaggagggccccaccgagcccccccccgccgagcccagaaccctgaacggcgtgagcagccccccccaccccagccccaagagccccgtgcagctggaggaggcccccttcagcagaagattcggcctgctgaagaccggcagcagcggcgccctgggcccccccgagagaagaaccgccgagggcgcccccggcgccggcctgcagagaagcgccagcagcagctggctggagggcaccagcacccaggccaaggagctgagactggccagaatcacccccacccccagccccaagctgcccgagcccagcgtgctgagcgaggtgaccaagccccccccctgcctggagaacagcagcccccccagcagaatccccgagcccgagagccccgccaagcccaacgtgcccaccgccagcaccgccccccccgccgacagcagagacagaagaagaagctaccagatgcccgtgagagacgaggagagcgagagccagagaaaggccagaagcagactgatgagacagagcagaagaagcacccagggcgtgaccctgaccgacctgaaggaggccgagaaggccggcgaggaggccgagcccgccgacagaagccaggagagcagcaccctggagggcggccccagcgccagaagacagagatggcagagagacctgaaccccgagcccgagcccgagagcgaggagcccgacggcggcttcagaaccctgtacgccgagctgagaagagagaacgagagactgagagaggccctgaccgagaccaccctgagactggcccagctgaaggtggagctggagagagccacccagagacaggagagattcgccgagagacccgccctgctggagctggagagattcgagagaagagccctggagagaaaggccgccgagctggaggaggagctgaaggccctgagcgacctgagagccgacaaccagagactgaaggacgagaacgccgccctgatcagagtgatcagcaagctgagcaagtag

SEQ ID NO: 95313 - DNA, 2124 bp, Artificial Sequence
  Description of Artificial Sequence: Synthetic coding sequence
atgagaaacggcggcccctgccagcccctggccgccggccccagagccgagggcgccagcgtgaactggagcgtgaccgcctggggccccggcacccaggcctgcatcgacgagaacctggaggtggtgagattcctggtggagcagggcgccaccgtgaaccaggccgacaacgagggctggacccccctgcacgtggccgccagctgcggctacctggacatcgccagatacctgctgagccacggcgccaacatcgccgccgtgaacagcgacggcgacctgcccctggacctggccgagagcgacgccatggagggcctgctgaaggccgagatcgccagaagaggcgtggacgtggaggccgccaagagagccgaggaggagctgctgctgcacgacaccagatgctggctgaacggcggcgccatgcccgaggccagacaccccagaaccggcgccagcgccctgcacgtggccgccgccaagggctacatcgaggtgatgagactgctgctgcaggccggctacgaccccgagctgagagacggcgacggctggacccccctgcacgccgccgcccactggggcgtggaggacgcctgcagactgctggccgagcacggcggcggcatggacagcctgacccacgccggccagagaccctgcgacctggccgacgaggaggtgctgagcctgctggaggagctggccagaaagcaggaggacctgagaaaccagaaggaggccagccagagcagaggccaggagccccaggcccccagcagcagcaagcacagaagaagcagcgtgtgcagactgagcagcagagagaagatcagcctgcaggacctgagcaaggagagaagacccggcggcgccggcggcccccccatccaggacgaggacgagggcgaggagggccccaccgagcccccccccgccgagcccagaaccctgaacggcgtgagcagccccccccaccccagccccaagagccccgtgcagctggaggaggcccccttcagcagaagattcggcctgctgaagaccggcagcagcggcgccctgggcccccccgagagaagaaccgccgagggcgcccccggcgccggcctgcagagaagcgccagcagcagctggctggagggcaccagcacccaggccaaggagctgagactggccagaatcacccccacccccagccccaagctgcccgagcccagcgtgctgagcgaggtgaccaagccccccccctgcctggagaacagcagcccccccagcagaatccccgagcccgagagccccgccaagcccaacgtgcccaccgccagcaccgccccccccgccgacagcagagacagaagaagaagctaccagatgcccgtgagagacgaggagagcgagagccagagaaaggccagaagcagactgatgagacagagcagaagaagcacccagggcgtgaccctgaccgacctgaaggaggccgagaaggccgccggcaaggcccccgagagcgagaagcccgcccagagcctggaccccagcagaagacccagagtgcccggcgtggagaacagcgacagccccgcccagagagaggcccccgacggccagggccccggcccccaggccgccagagagcacagaaaggtgggcaaggagtggagaggccccgccgagggcgaggaggccgagcccgccgacagaagccaggagagcagcaccctggagggcggccccagcgccagaagacagagatggcagagagacctgaaccccgagcccgagcccgagagcgaggagcccgacggcggcttcagaaccctgtacgccgagctgagaagagagaacgagagactgagagaggccctgaccgagaccaccctgagactggcccagctgaaggtggagctggagagagccacccagagacaggagagattcgccgagagacccgccctgctggagctggagagattcgagagaagagccctggagagaaaggccgccgagctggaggaggagctgaaggccctgagcgacctgagagccgacaaccagagactgaaggacgagaacgccgccctgatcagagtgatcagcaagctgagcaagtag

SEQ ID NO: 95314 - DNA, 2142 bp, Artificial Sequence
  Description of Artificial Sequence: Synthetic coding sequence
atggagcccggcaccggcggcagcagaaagagactgggccccagagccggcttcagattctggccccccttcttccccagaagaagccaggccggcagcagcaagttccccacccccctgggccccgagaacagcggcaaccccaccctgctgagcagcgcccagcccgagaccagagtgagctactggaccaagctgctgagccagctgctggcccccctgcccggcctgctgcagaaggtgctgatctggagccagctgttcggcggcatgttccccaccagatggctggacttcgccggcgtgtacagcgccctgagagccctgaagggcagagagaagcccgccgcccccaccgcccagaagagcctgagcagcctgcagctggacagcagcgaccccagcgtgaccagccccctggactggctggaggagggcatccactggcagtacagcccccccgacctgaagctggagctgaaggccaagggcagcgccctggaccccgccgcccaggccttcctgctggagcagcagctgtggggcgtggagctgctgcccagcagcctgcagagcagactgtacagcaacagagagctgggcagcagccccagcggccccctgaacatccagagaatcgacaacttcagcgtggtgagctacctgctgaaccccagctacctggactgcttccccagactggaggtgagctaccagaacagcgacggcaacagcgaggtggtgggcttccagaccctgacccccgagagcagctgcctgagagaggaccactgccacccccagcccctgagcgccgagctgatccccgccagctggcagggctgcccccccctgagcaccgagggcctgcccgagatccaccacctgagaatgaagagactggagttcctgcagcaggccaacaagggccaggacctgcccacccccgaccaggacaacggctaccacagcctggaggaggagcacagcctgctgagaatggaccccaagcactgcagagacaaccccacccagttcgtgcccgccgccggcgacatccccggcaacacccaggagagcaccgaggagaagatcgagctgctgaccaccgaggtgcccctggccctggaggaggagagccccagcgagggctgccccagcagcgagatccccatggagaaggagcccggcgagggcagaatcagcgtggtggactacagctacctggagggcgacctgcccatcagcgccagacccgcctgcagcaacaagctgatcgactacatcctgggcggcgccagcagcgacctggagaccagcagcgaccccgagggcgaggactgggacgaggaggccgaggacgacggcttcgacagcgacagcagcctgagcgacagcgacctggagcaggaccccgagggcctgcacctgtggaacagcttctgcagcgtggacccctacaacccccagaacttcaccgccaccatccagaccgccgccagaatcgtgcccgaggagcccagcgacagcgagaaggacctgagcggcaagagcgacctggagaacagcagccagagcggcagcctgcccgagacccccgagcacagcagcggcgaggaggacgactgggagagcagcgccgacgaggccgagagcctgaagctgtggaacagcttctgcaacagcgacgacccctacaaccccctgaacttcaaggcccccttccagaccagcggcgagaacgagaagggctgcagagacagcaagacccccagcgagagcatcgtggccatcagcgagtgccacaccctgctgagctgcaaggtgcagctgctgggcagccaggagagcgagtgccccgacagcgtgcagagagacgtgctgagcggcggcagacacacccacgtgaagagaaagaaggtgaccttcctggaggaggtgaccgagtactacatcagcggcgacgaggacagaaagggcccctgggaggagttcgccagagacggctgcagattccagaagagaatccaggagaccgaggacgccatcggctactgcctgaccttcgagcacagagagagaatgttcaacagactgcagggcacctgcttcaagggcctgaacgtgctgaagcagtgctag

SEQ ID NO: 95315 - DNA, 1872 bp, Artificial Sequence
  Description of Artificial Sequence: Synthetic coding sequence
atgttccccaccagatggctggacttcgccggcgtgtacagcgccctgagagccctgaagggcagagagaagcccgccgcccccaccgcccagaagagcctgagcagcctgcagctggacagcagcgaccccagcgtgaccagccccctggactggctggaggagggcatccactggcagtacagcccccccgacctgaagctggagctgaaggccaagggcagcgccctggaccccgccgcccaggccttcctgctggagcagcagctgtggggcgtggagctgctgcccagcagcctgcagagcagactgtacagcaacagagagctgggcagcagccccagcggccccctgaacatccagagaatcgacaacttcagcgtggtgagctacctgctgaaccccagctacctggactgcttccccagactggaggtgagctaccagaacagcgacggcaacagcgaggtggtgggcttccagaccctgacccccgagagcagctgcctgagagaggaccactgccacccccagcccctgagcgccgagctgatccccgccagctggcagggctgcccccccctgagcaccgagggcctgcccgagatccaccacctgagaatgaagagactggagttcctgcagcaggccaacaagggccaggacctgcccacccccgaccaggacaacggctaccacagcctggaggaggagcacagcctgctgagaatggaccccaagcactgcagagacaaccccacccagttcgtgcccgccgccggcgacatccccggcaacacccaggagagcaccgaggagaagatcgagctgctgaccaccgaggtgcccctggccctggaggaggagagccccagcgagggctgccccagcagcgagatccccatggagaaggagcccggcgagggcagaatcagcgtggtggactacagctacctggagggcgacctgcccatcagcgccagacccgcctgcagcaacaagctgatcgactacatcctgggcggcgccagcagcgacctggagaccagcagcgaccccgagggcgaggactgggacgaggaggccgaggacgacggcttcgacagcgacagcagcctgagcgacagcgacctggagcaggaccccgagggcctgcacctgtggaacagcttctgcagcgtggacccctacaacccccagaacttcaccgccaccatccagaccgccgccagaatcgtgcccgaggagcccagcgacagcgagaaggacctgagcggcaagagcgacctggagaacagcagccagagcggcagcctgcccgagacccccgagcacagcagcggcgaggaggacgactgggagagcagcgccgacgaggccgagagcctgaagctgtggaacagcttctgcaacagcgacgacccctacaaccccctgaacttcaaggcccccttccagaccagcggcgagaacgagaagggctgcagagacagcaagacccccagcgagagcatcgtggccatcagcgagtgccacaccctgctgagctgcaaggtgcagctgctgggcagccaggagagcgagtgccccgacagcgtgcagagagacgtgctgagcggcggcagacacacccacgtgaagagaaagaaggtgaccttcctggaggaggtgaccgagtactacatcagcggcgacgaggacagaaagggcccctgggaggagttcgccagagacggctgcagattccagaagagaatccaggagaccgaggacgccatcggctactgcctgaccttcgagcacagagagagaatgttcaacagactgcagggcacctgcttcaagggcctgaacgtgctgaagcagtgctag

SEQ ID NO: 95316 - DNA, 1704 bp, Artificial Sequence
  Description of Artificial Sequence: Synthetic coding sequence
atggccagccacgtggacctgctgaccgagctgcagctgctggagaaggtgcccaccctggagagactgagagccgcccagaagagaagagcccagcagctgaagaagtgggcccagtacgagcaggacctgcagcacagaaagagaaagcacgagagaaagagaagcaccggcggcagaagaaagaaggtgagcttcgaggccagcgtggccctgctggaggccagcctgagaaacgacgccgaggaggtgagatacttcctgaagaacaaggtgagccccgacctgtgcaacgaggacggcctgaccgccctgcaccagtgctgcatcgacaacttcgaggagatcgtgaagctgctgctgagccacggcgccaacgtgaacgccaaggacaacgagctgtggacccccctgcacgccgccgccacctgcggccacatcaacctggtgaagatcctggtgcagtacggcgccgacctgctggccgtgaacagcgacggcaacatgccctacgacctgtgcgaggacgagcccaccctggacgtgatcgagacctgcatggcctaccagggcatcacccaggagaagatcaacgagatgagagtggcccccgagcagcagatgatcgccgacatccactgcatgatcgccgccggccaggacctggactggatcgacgcccagggcgccaccctgctgcacatcgccggcgccaacggctacctgagagccgccgagctgctgctggaccacggcgtgagagtggacgtgaaggactgggacggctgggagcccctgcacgccgccgccttctggggccagatgcagatggccgagctgctggtgagccacggcgccagcctgagcgccagaaccagcatggacgagatgcccatcgacctgtgcgaggaggaggagttcaaggtgctgctgctggagctgaagcacaagcacgacgtgatcatgaagagccagctgagacacaagagcagcctgagcagaagaaccagcagcgccggcagcagaggcaaggtggtgagaagagccagcctgagcgacagaaccaacctgtacagaaaggagtacgagggcgaggccatcctgtggcagagaagcgccgccgaggaccagagaaccagcacctacaacggcgacatcagagagaccagaaccgaccaggagaacaaggaccccaaccccagactggagaagcccgtgctgctgagcgagttccccaccaagatccccagaggcgagctggacatgcccgtggagaacggcctgagagcccccgtgagcgcctaccagtacgccctggccaacggcgacgtgtggaaggtgcacgaggtgcccgactacagcatggcctacggcaaccccggcgtggccgacgccacccccccctggagcagctacaaggagcagagcccccagaccctgctggagctgaagagacagagagccgccgccaagctgctgagccaccccttcctgagcacccacctgggcagcagcatggccagaaccggcgagagcagcagcgagggcaaggcccccctgatcggcggcagaaccagcccctacagcagcaacggcaccagcgtgtactacaccgtgaccagcggcgacccccccctgctgaagttcaaggcccccatcgaggagatggaggagaaggtgcacggctgctgcagaatcagctag

SEQ ID NO: 95317 - DNA, 1578 bp, Artificial Sequence
  Description of Artificial Sequence: Synthetic coding sequence
atggccagccacgtggacctgctgaccgagctgcagctgctggagaaggtgcccaccctggagagactgagagccgcccagaagagaagagcccagcagctgaagaagtgggcccagtacgagcaggacctgcagcacagaaagagaaagcacgagagaaagagaagcaccggcggcagaagaaagaaggtgagcttcgaggccagcgtggccctgctggaggccagcctgagaaacgacgccgaggaggtgagatacttcctgaagaacaaggtgagccccgacctgtgcaacgaggacggcctgaccgccctgcaccagtgctgcatcgacaacttcgaggagatcgtgaagctgctgctgagccacggcgccaacgtgaacgccaaggacaacgagctgtggacccccctgcacgccgccgccacctgcggccacatcaacctggtgaagatcctggtgcagtacggcgccgacctgctggccgtgaacagcgacggcaacatgccctacgacctgtgcgaggacgagcccaccctggacgtgatcgagacctgcatggcctaccagggcatcacccaggagaagatcaacgagatgagagtggcccccgagcagcagatgatcgccgacatccactgcatgatcgccgccggccaggacctggactggatcgacgcccagggcgccaccctgatgcagatggccgagctgctggtgagccacggcgccagcctgagcgccagaaccagcatggacgagatgcccatcgacctgtgcgaggaggaggagttcaaggtgctgctgctggagctgaagcacaagcacgacgtgatcatgaagagccagctgagacacaagagcagcctgagcagaagaaccagcagcgccggcagcagaggcaaggtggtgagaagagccagcctgagcgacagaaccaacctgtacagaaaggagtacgagggcgaggccatcctgtggcagagaagcgccgccgaggaccagagaaccagcacctacaacggcgacatcagagagaccagaaccgaccaggagaacaaggaccccaaccccagactggagaagcccgtgctgctgagcgagttccccaccaagatccccagaggcgagctggacatgcccgtggagaacggcctgagagcccccgtgagcgcctaccagtacgccctggccaacggcgacgtgtggaaggtgcacgaggtgcccgactacagcatggcctacggcaaccccggcgtggccgacgccacccccccctggagcagctacaaggagcagagcccccagaccctgctggagctgaagagacagagagccgccgccaagctgctgagccaccccttcctgagcacccacctgggcagcagcatggccagaaccggcgagagcagcagcgagggcaaggcccccctgatcggcggcagaaccagcccctacagcagcaacggcaccagcgtgtactacaccgtgaccagcggcgacccccccctgctgaagttcaaggcccccatcgaggagatggaggagaaggtgcacggctgctgcagaatcagctag

SEQ ID NO: 95318 - DNA, 3369 bp, Artificial Sequence
  Description of Artificial Sequence: Synthetic coding sequence
atggagcccagcgaggtgcccagccagatcagcaaggacaacttcctggaggtgcccaacctgagcgacagcctgtgcgaggacgaggaggtgaccttccagcccggcttcagcccccagcccagcagaagaggcagcgacagcagcgaggacatctacctggacacccccagcagcggcaccagaagagtgagcttcgccgacagcttcggcttcaacctggtgagcgtgaaggagttcgactgctgggagctgcccagcgccagcaccaccttcgacctgggcaccgacatcttccacaccgaggagtacgtgctggcccccctgttcgacctgcccagcagcaaggaggacctgatgcagcagctgcagatccagaaggccatcctggagagcaccgagagcctgctgggcagcaccagcatcaagggcatcatcagagtgctgaacgtgagcttcgagaagctggtgtacgtgagaatgagcctggacgactggcagacccactacgacatcctggccgagtacgtgcccaacagctgcgacggcgagaccgaccagttcagcttcaagatcgtgctggtgcccccctaccagaaggacggcagcaaggtggagttctgcatcagatacgagaccagcgtgggcaccttctggagcaacaacaacggcaccaactacaccttcatctgccagaagaaggagcaggagcccgagcccgtgaagccctggaaggaggtgcccaacagacagatcaagggctgcctgaaggtgaagagcagcaaggaggagagcagcgtgaccagcgaggagaacaacttcgagaaccccaagaacaccgacacctacatccccaccatcatctgcagccacgaggacaaggaggacctggaggccagcaacagaaacgtgaaggacgtgaacagagagcacgacgagcacaacgagaaggagctggagctgatgatcaaccagcacctgatcagaaccagaagcaccgccagcagagacgagagaaacaccttcagcaccgaccccgtgaacttccccaacaaggccgagggcctggagaagaagcagatccacggcgagatctgcaccgacctgttccagagaagcctgagccccagcagcagcgccgagagcagcgtgaagggcgacttctactgcaacgagaagtacagcagcggcgacgactgcacccaccagcccagcgaggagaccaccagcaacatgggcgagatcaagcccagcctgggcgacaccagcagcgacgagctggtgcagctgcacaccggcagcaaggaggtgctggacgacaacgccaaccccgcccacggcaacggcaccgtgcagatcccctgccccagcagcgaccagctgatggccggcaacctgaacaagaagcacgagggcggcgccaagaacatcgaggtgaaggacctgggctgcctgagaagagacttccacagcgacaccagcgcctgcctgaaggagagcaccgaggagggcagcagcaaggaggactactacggcaacggcaaggacgacgaggagcagagaatctacctgggcgtgaacgagaagcagagaaagaacttccagaccatcctgcacgaccaggagagaaagatgggcaaccccaagatcagcgtggccggcatcggcgccagcaacagagacctggccaccctgctgagcgagcacaccgccatccccaccagagccatcaccgccgacgtgagccacagccccagaaccaacctgagctgggaggaggccgtgctgacccccgagcaccaccacctgaccagcgagggcagcgccctgggcggcatcaccggccaggtgtgcagcagcagaaccggcaacgtgctgagaaacgactacctgttccaggtggaggagaagagcggcggcatcaacagcgaggaccaggacaacagcccccagcacaagcagagctggaacgtgctggagagccagggcaagagcagagagaacaagaccaacatcaccgagcacatcaagggccagaccgactgcgaggacgtgtggggcaagagagacaacaccagaagcctgaaggccaccaccgaggagctgttcacctgccaggagaccgtgtgctgcgagctgagcagcctggccgaccacggcatcaccgagaaggccgaggccggcaccgcctacatcatcaagaccaccagcgagagcacccccgagagcatgagcgccagagagaaggccatcatcgccaagctgccccaggagaccgccagaagcgacagacccatcgaggtgaaggagaccgccttcgacccccacgagggcagaaacgacgacagccactacaccctgtgccagagagacaccgtgggcgtgatctacgacaacgacttcgagaaggagagcagactgggcatctgcaacgtgagagtggacgagatggagaaggaggagaccatgagcatgtacaaccccagaaagacccacgacagagagaagtgcggcaccggcaacatcaccagcgtggaggagagcagctgggtgatcaccgagtaccagaaggccaccagcaagctggacctgcagctgggcatgctgcccaccgacaagaccgtgttcagcgagaacagagacctgagacaggtgcaggagctgagcaagaagaccgacagcgacgccatcgtgcacagcgccttcaacagcgacaccaacagagccccccagaacagcagccccttcagcaagcaccacaccgagatcagcgtgagcaccaacgagcaggccatcgccgtggagaacgccgtgaccaccatggccagccagcccatcagcaccaagagcgagaacatctgcaacagcaccagagagatccagggcatcgagaagcacccctaccccgagagcaagcccgaggaggtgagcagaagcagcggcatcgtgaccagcggcagcagaaaggagagatgcatcggccagatcttccagaccgaggagtacagcgtggagaagagcctgggccccatgatcctgatcaacaagcccctggagaacatggaggaggccagacacgagaacgagggcctggtgagcagcggccagagcctgtacaccagcggcgagaaggagagcgacagcagcgccagcaccagcctgcccgtggaggagagccaggcccagggcaacgagagcctgttcagcaagtacaccaacagcaagatcccctacttcctgctgttcctgatcttcctgatcaccgtgtaccactacgacctgatgatcggcctgaccttctacgtgctgagcctgagctggctgagctgggaggagggcagacagaaggagagcgtgaagaagaagtag

SEQ ID NO: 95319 - DNA, 954 bp, Artificial Sequence
  Description of Artificial Sequence: Synthetic coding sequence
atgagctgcaccagaatgatccaggtgctggaccccagacccctgaccagcagcgtgatgcccgtggacgtggccatgagactgtgcctggcccacagcccccccgtgaagagcttcctgggcccctacgacgagttccagagaagacacttcgtgaacaagctgaagcccctgaagagctgcctgaacatcaagcacaaggccaagagccagaacgactggaagtgcagccacaaccaggccaagaagagagtggtgttcgccgacagcaagggcctgagcctgaccgccatccacgtgttcagcgacctgcccgaggagcccgcctgggacctgcagttcgacctgctggacctgaacgacatcagcagcgccctgaagcaccacgaggagaagaacctgatcctggacttcccccagcccagcaccgactacctgagcttcagaagccacttccagaagaacttcgtgtgcctggagaactgcagcctgcaggagagaaccgtgaccggcaccgtgaaggtgaagaacgtgagcttcgagaagaaggtgcagatcagaatcaccttcgacagctggaagaactacaccgacgtggactgcgtgtacatgaagaacgtgtacggcggcaccgacagcgacaccttcagcttcgccatcgacctgccccccgtgatccccaccgagcagaagatcgagttctgcatcagctaccacgccaacggccaggtgttctgggacaacaacgacggccagaactacagaatcgtgcacgtgcagtggaagcccgacggcgtgcagacccagatggccccccaggactgcgccttccaccagaccagccccaagaccgagctggagagcaccatcttcggcagccccagactggccagcggcctgttccccgagtggcagagctggggcagaatggagaacctggccagctacagatag

SEQ ID NO: 95320 - DNA, 894 bp, Artificial Sequence
  Description of Artificial Sequence: Synthetic coding sequence
atgagctgcaccagaatgatccaggtgctggaccccagacccctgaccagcagcgtgatgcccgtggacgtggccatgagactgtgcctggcccacagcccccccgtgaagagcttcctgggcccctacgacgagttccagagaagacacttcgtgaacaagctgaagcccctgaagagctgcctgaacatcaagcacaaggccaagagccagaacgactggaagtgcagccacaaccaggccaagaagagagtggtgttcgccgacagcaagggcctgagcctgaccgccatccacgtgttcagcgacctgcccgaggagcccgcctgggacctgcagttcgacctgctggacctgaacgacatcagcagcgccctgagcttcagaagccacttccagaagaacttcgtgtgcctggagaactgcagcctgcaggagagaaccgtgaccggcaccgtgaaggtgaagaacgtgagcttcgagaagaaggtgcagatcagaatcaccttcgacagctggaagaactacaccgacgtggactgcgtgtacatgaagaacgtgtacggcggcaccgacagcgacaccttcagcttcgccatcgacctgccccccgtgatccccaccgagcagaagatcgagttctgcatcagctaccacgccaacggccaggtgttctgggacaacaacgacggccagaactacagaatcgtgcacgtgcagtggaagcccgacggcgtgcagacccagatggccccccaggactgcgccttccaccagaccagccccaagaccgagctggagagcaccatcttcggcagccccagactggccagcggcctgttccccgagtggcagagctggggcagaatggagaacctggccagctacagatag

SEQ ID NO: 95321 - DNA, 600 bp, Artificial Sequence
  Description of Artificial Sequence: Synthetic coding sequence
atgagcagccccaccagccccctgaagcaccacgaggagaagaacctgatcctggacttcccccagcccagcaccgactacctgagcttcagaagccacttccagaagaacttcgtgtgcctggagaactgcagcctgcaggagagaaccgtgaccggcaccgtgaaggtgaagaacgtgagcttcgagaagaaggtgcagatcagaatcaccttcgacagctggaagaactacaccgacgtggactgcgtgtacatgaagaacgtgtacggcggcaccgacagcgacaccttcagcttcgccatcgacctgccccccgtgatccccaccgagcagaagatcgagttctgcatcagctaccacgccaacggccaggtgttctgggacaacaacgacggccagaactacagaatcgtgcacgtgcagtggaagcccgacggcgtgcagacccagatggccccccaggactgcgccttccaccagaccagccccaagaccgagctggagagcaccatcttcggcagccccagactggccagcggcctgttccccgagtggcagagctggggcagaatggagaacctggccagctacagatag

SEQ ID NO: 95322 - DNA, 900 bp, Artificial Sequence
  Description of Artificial Sequence: Synthetic coding sequence
atgagcagaggccccagcagcgccgtgctgcccagcgccctgggcagcagaaagctgggccccagaagcctgagctgcctgagcgacctggacggcggcgtggccctggagcccagagcctgcagaccccccggcagccccggcagagcccccccccccacccccgcccccagcggctgcgaccccagactgagacccatcatcctgagaagagccagaagcctgcccagcagccccgagagaagacagaaggccgccggcgcccccggcgccgcctgcagacccggctgcagccagaagctgagagtgagattcgccgacgccctgggcctggagctggcccaggtgaaggtgttcaacgccggcgacgaccccagcgtgcccctgcacgtgctgagcagactggccatcaacagcgacctgtgctgcagcagccaggacctggagttcaccctgcactgcctggtgcccgacttccccccccccgtggaggccgccgacttcggcgagagactgcagagacagctggtgtgcctggagagagtgacctgcagcgacctgggcatcagcggcaccgtgagagtgtgcaacgtggccttcgagaagcaggtggccgtgagatacaccttcagcggctggagaagcacccacgaggccgtggccagatggagaggccccgccggccccgagggcaccgaggacgtgttcaccttcggcttccccgtgccccccttcctgctggagctgggcagcagagtgcacttcgccgtgagataccaggtggccggcgccgagtactgggacaacaacgaccacagagactacagcctgacctgcagaaaccacgccctgcacatgcccagaggcgagtgcgaggagagctggatccacttcatctag

SEQ ID NO: 95323 - DNA, 756 bp, Artificial Sequence
  Description of Artificial Sequence: Synthetic coding sequence
atgaccagactgaccgtgctggccctgctggccggcctgctggccagcagcagagccggcagcagccccctgctggacatcgtgggcggcagaaaggccagacccagacagttccccttcctggccagcatccagaaccagggcagacacttctgcggcggcgccctgatccacgccagattcgtgatgaccgccgccagctgcttccagagccagaaccccggcgtgagcaccgtggtgctgggcgcctacgacctgagaagaagagagagacagagcagacagaccttcagcatcagcagcatgagcgagaacggctacgacccccagcagaacctgaacgacctgatgctgctgcagctggacagagaggccaacctgaccagcagcgtgaccatcctgcccctgcccctgcagaacgccaccgtggaggccggcaccagatgccaggtggccggctggggcagccagagaagcggcggcagactgagcagattccccagattcgtgaacgtgaccgtgacccccgaggaccagtgcagacccaacaacgtgtgcaccggcgtgctgaccagaagaggcggcatctgcaacggcgacggcggcacccccctggtgtgcgagggcctggcccacggcgtggccagcttcagcctgggcccctgcggcagaggccccgacttcttcaccagagtggccctgttcagagactggatcgacggcgtgctgaacaaccccggccccggccccgcctag

SEQ ID NO: 95324 - DNA, 954 bp, Artificial Sequence
  Description of Artificial Sequence: Synthetic coding sequence
atggccgccgagagaggcgccggccagcagcagagccaggagatgatggaggaggagcacgagctgcccgtggacatggagaccatcaacctggacagagacgccgaggacgtggacctgaaccactacagaatcggcaagatcgagggcttcgaggtgctgaagaaggtgaagaccctgtgcctgagacagaacctgatcaagtgcatcgagaacctggaggagctgcagagcctgagagagctggacctgtacgacaaccagatcaagaagatcgagaacctggaggccctgaccgagctggagatcctggacatcagcttcaacctgctgagaaacatcgagggcgtggacaagctgaccagactgaagaagctgttcctggtgaacaacaagatcagcaagatcgagaacctgagcaacctgcaccagctgcagatgctggagctgggcagcaacagaatcagagccatcgagaacatcgacaccctgaccaacctggagagcctgttcctgggcaagaacaagatcaccaagctgcagaacctggacgccctgaccaacctgaccgtgctgagcatgcagagcaacagactgaccaagatcgagggcctgcagaacctggtgaacctgagagagctgtacctgagccacaacggcatcgaggtgatcgagggcctggagaacaacaacaagctgaccatgctggacatcgccagcaacagaatcaagaagatcgagaacatcagccacctgaccgagctgcaggagttctggatgaacgacaacctgctggagagctggagcgacctggacgagctgaagggcgccagaagcctggagaccgtgtacctggagagaaaccccctgcagaaggacccccagtacagaagaaaggtgatgctggccctgcccagcgtgagacagatcgacgccaccttcgtgagattctag

SEQ ID NO: 95325 - DNA, 714 bp, Artificial Sequence
  Description of Artificial Sequence: Synthetic coding sequence
atggccgccgagagaggcgccggccagcagcagagccaggagatgatggaggaggagcacgagctgcccgtggacatggagaccatcaacctggacagagacgccgaggacgtggacctgaaccactacagaatcggcaagatcgagggcttcgaggtgctgaagaaggtgaagaccctgtgcctgagacagaacctgatcaagtgcatcgagaacctggaggagctgcagagcctgagagagctggacctgtacgacaaccagatcaagaagatcgagaacctggaggccctgaccgagctggagatcctggacatcagcttcaacctgctgagaaacatcgagggcgtggacaagctgaccagactgaagaagctgttcctggtgaacaacaagatcagcaagatcgagaacctgagcaacctgcaccagctgcagatgctggagctgggcagcaacagaatcagagccatcgagaacatcgacaccctgaccaacctggagagcctgttcctgggcaagaacaagatcaccaagctgcagaacctggacgccctgaccaacctgaccgtgctgagcatgcagagcaacagactgaccaagatcgagggcctgcagaacctggtgaacctgagagagctgtacctgagccacaacggcatcgaggtgatcgagggcctggagaacaacgtgcaggacagcctgacctactag

SEQ ID NO: 95326 - DNA, 843 bp, Artificial Sequence
  Description of Artificial Sequence: Synthetic coding sequence
atggccgccgagagaggcgccggccagcagcagagccaggagatgatggaggtggacagaagagtggagagcgaggagagcggcgacgaggagggcaagaagcacagcagcggcatcgtggccgacctgagcgagcagagcctgaaggacggcgaggagagaggcgaggaggaccccgaggaggagcacgagctgcccgtggacatggagaccatcaacctggacagagacgccgaggacgtggacctgaaccactacagaatcggcaagatcgagggcttcgaggtgctgaagaaggtgaagaccctgtgcctgagacagaacctgatcaagtgcatcgagaacctggaggagctgcagagcctgagagagctggacctgtacgacaaccagatcaagaagatcgagaacctggaggccctgaccgagctggagatcctggacatcagcttcaacctgctgagaaacatcgagggcgtggacaagctgaccagactgaagaagctgttcctggtgaacaacaagatcagcaagatcgagaacctgagcaacctgcaccagctgcagatgctggagctgggcagcaacagaatcagagccatcgagaacatcgacaccctgaccaacctggagagcctgttcctgggcaagaacaagatcaccaagctgcagaacctggacgccctgaccaacctgaccgtgctgagcatgcagagcaacagactgaccaagatcgagggcctgcagaacctggtgaacctgagagagctgtacctgagccacaacggcatcgaggtgatcgagggcctggagaacaacgtgcaggacagcctgacctactag

SEQ ID NO: 95327 - DNA, 1083 bp, Artificial Sequence; identical to SEQ ID NO: 92533
  Description of Artificial Sequence: Synthetic coding sequence

SEQ ID NO: 95328 - DNA, 384 bp, Artificial Sequence
  Description of Artificial Sequence: Synthetic coding sequence
atggtgcagaccgccgtggtgcccgtgaagaagaagagagtggagggccccggcagcctgggcctggaggagagcggcagcagaagaatgcagaacttcgccttcagcggcggcctgtacggcggcctgccccccacccacagcgaggccggcagccagccccacggcatccacggcaccgccctgatcggcggcctgcccatgccctaccccaacctggcccccgacgtggacctgacccccgtggtgcccagcgccgtgaacatgaaccccgcccccaaccccgccgtgtacaaccccgaggccgtgaacgagcccaagaagaagaagtacgccaaggaggcctggcccggcaagaagcccacccccagcctgctgatctag

SEQ ID NO: 95329 - DNA, 1056 bp, Artificial Sequence
  Description of Artificial Sequence: Synthetic coding sequence
atggccgccgccgccaacagcggcagcagcctgcccctgttcgactgccccacctgggccggcaagcccccccccggcctgcacctggacgtggtgaagggcgacaagctgatcgagaagctgatcatcgacgagaagaagtactacctgttcggcagaaaccccgacctgtgcgacttcaccatcgaccaccagagctgcagcagagtgcacgccgccctggtgtaccacaagcacctgaagagagtgttcctgatcgacctgaacagcacccacggcaccttcctgggccacatcagactggagccccacaagccccagcagatccccatcgacagcaccgtgagcttcggcgccagcaccagagcctacaccctgagagagaagccccagaccctgcccagcgccgtgaagggcgacgagaagatgggcggcgaggacgacgagctgaagggcctgctgggcctgcccgaggaggagaccgagctggacaacctgaccgagttcaacaccgcccacaacaagagaatcagcaccctgaccatcgaggagggcaacctggacatccagagacccaagagaaagagaaagaacagcagagtgaccttcagcgaggacgacgagatcatcaaccccgaggacgtggaccccagcgtgggcagattcagaaacatggtgcagaccgccgtggtgcccgtgaagaagaagagagtggagggccccggcagcctgggcctggaggagagcggcagcagaagaatgcagaacttcgccttcagcggcggcctgtacggcggcctgccccccacccacagcgaggccggcagccagccccacggcatccacggcaccgccctgatcggcggcctgcccatgccctaccccaacctggcccccgacgtggacctgacccccgtggtgcccagcgccgtgaacatgaaccccgcccccaaccccgccgtgtacaaccccgaggccgtgaacgagcccaagaagaagaagtacgccaaggaggcctggcccggcaagaagcccacccccagcctgctgatctag

SEQ ID NO: 95330 - DNA, 630 bp, Artificial Sequence
  Description of Artificial Sequence: Synthetic coding sequence
atgggcggcgaggacgacgagctgaagggcctgctgggcctgcccgaggaggagaccgagctggacaacctgaccgagttcaacaccgcccacaacaagagaatcagcaccctgaccatcgaggagggcaacctggacatccagagacccaagagaaagagaaagaacagcagagtgaccttcagcgaggacgacgagatcatcaaccccgaggacgtggaccccagcgtgggcagattcagaaacatggtgcagaccgccgtggtgcccgtgaagaagaagagagtggagggccccggcagcctgggcctggaggagagcggcagcagaagaatgcagaacttcgccttcagcggcggcctgtacggcggcctgccccccacccacagcgaggccggcagccagccccacggcatccacggcaccgccctgatcggcggcctgcccatgccctaccccaacctggcccccgacgtggacctgacccccgtggtgcccagcgccgtgaacatgaaccccgcccccaaccccgccgtgtacaaccccgaggccgtgaacgagcccaagaagaagaagtacgccaaggaggcctggcccggcaagaagcccacccccagcctgctgatctag

SEQ ID NO: 95331 - DNA, 711 bp, Artificial Sequence
  Description of Artificial Sequence: Synthetic coding sequence
atgggcggcgaggacgacgagctgaagggcctgctgggcctgcccgaggaggagaccgagctggacaacctgaccgagttcaacaccgcccacaacaagagaatcagcaccctgaccatcgaggagggcaacctggacatccagagacccaagagaaagagaaagaacagcagagtgaccttcagcgaggacgacgagatcatcaaccccgaggacgtggaccccagcgtgggcagattcagaaacatggtgcagaccgccgtggtgcccgtgaagaagaagagagtggagggccccggcagcctgggcctggaggagagcggcagcagaagaatgcagaacttcgccttcagcggcggcctgtacggcggcctgccccccacccacagcgaggccggcagccagccccacggcatccacggcaccgccctgatcggcggcctgcccatgccctaccccaacctggcccccgacgtggacctgacccccgtggtgcccagcgccgtgaacatgaaccccgcccccaaccccgccgtgtacaaccccgaggccgtgaacgagcccaagaagaagaagtacgccaaggaggcctggcccggctgcgagttcgtgagccagagcctgatcgccaccgccatctggaagtgcctgctgaaggcccagagcctgggcctgggcggcaacgcccccagccccctgtactacaagtag

SEQ ID NO: 95332 - DNA, 618 bp, Artificial Sequence
  Description of Artificial Sequence: Synthetic coding sequence
atgggcggcgaggacgacgagctgaagggcctgctgggcctgcccgaggaggagaccgagctggacaacctgaccgagttcaacaccgcccacaacaagagaatcagcaccctgaccatcgaggagggcaacctggacatccagagacccaagagaaagagaaagaacagcagagtgaccttcagcgaggacgacgagatcatcaaccccgaggacgtggaccccagcgtgggcagattcagaaacatggtgcagaccgccgtggtgcccgtgaagaagaagagagtggagggccccggcagcctgggcctggaggagagcggcagcagaagaatgcagaacttcgccttcagcggcggcctgtacggcggcctgccccccacccacagcgaggccggcagccagccccacggcatccacggcaccgccctgatcggcggcctgcccatgccctaccccaacctggcccccgacgtggacctgacccccgtggtgcccagcgccgtgaacatgaaccccgcccccaaccccgccgtgtacaaccccgaggccgtgaacgagcccaagaagaagaagtacgccaaggaggcctggcccggcaagaagcccaccccctag

SEQ ID NO: 95333 - DNA, 600 bp, Artificial Sequence
  Description of Artificial Sequence: Synthetic coding sequence
atggccgccgccgccaacagcggcagcagcctgcccctgttcgactgccccacctgggccggcaagcccccccccggcctgcacctggacgtggtgaagggcgacaagctgatcgagaagctgatcatcgacgagaagaagtactacctgttcggcagaaaccccgacctgtgcgacttcaccatcgaccaccagagctgcagcagagtgcacgccgccctggtgtaccacaagcacctgaagagagtgttcctgatcgacctgaacagcacccacggcaccttcctgggccacatcagactggagccccacaagccccagcagatccccatcgacagcaccgtgagcttcggcgccagcaccagagcctacaccctgagagagaagccccagaccctgcccagcgccgtgaagggcgacgagaagatgggcggcgaggacgacgagctgaagggcctgctgggcctgcccgaggaggagaccgagctggacaacctgaccgagttcaacaccgcccacaaccacatggccagcatgggccagcacagcagcgtggcctgcccctgccacacccagaccctgcccctgatgtggacctag

SEQ ID NO: 95334 - DNA, 3891 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggcgagcagaagaccaaggagggcgagggcagccagcagagcagaggcagaaagtacggcagcaacgtgaacagaatcaagaacctgttcatgcagatgggcatggagcccaacgagaacgccgccgtgatcgccaagaccagaggcaagggcggccacagcagcccccagagaagaatgaagcccaaggagttcctggagaagaccgacggcagcgtggtgaagctggagagcagcgtgagcgagagaatcagcagattcgacaccatgtacgacggccccagctacagcaagttcaccgagaccagaaagatgttcgagagaagcgtgcacgagagcggccagaacaacagatacagccccaagaaggagaaggccggcggcagcgagccccaggacgagtggggcggcagcaagagcaacagaggcagcaccgacagcctggacagcctgagcagcagaaccgaggccgtgagccccaccgtgagccagctgagcgccgtgttcgagaacaccgacagccccagcgccatcatcagcgagaaggccgagaacaacgagtacagcgtgaccggccactaccccctgaacctgcccagcgtgaccgtgaccaacctggacaccttcggccacctgaaggacagcaacagctggccccccagcaacaagagaggcgtggacaccgaggacgcccacaagagcaacgccacccccgtgcccgaggtggccagcaagagcaccagcctggccagcatccccggcgaggagatccagcagagcaaggagcccgaggacagcaccagcaaccagcagacccccgacagcatcgacaaggacggccccgaggagccctgcgccgagagcaaggccatgcccaagagcgagatccccagcccccagagccagctgctggaggacgccgaggccaacctggtgggcagagaggccgccaagcagcagagaaaggagctggccggcggcgacttcaccagccccgacgccagcgccagcagctgcggcaaggaggtgcccgaggacagcaacaacttcgacggcagccacgtgtacatgcacagcgactacaacgtgtacagagtgagaagcagatacaacagcgactggggcgagaccggcaccgagcaggacgaggaggaggacagcgacgagaacagctactaccagcccgacatggagtacagcgagatcgtgggcctgcccgaggaggaggagatccccgccaacagaaagatcaagttcagcagcgcccccatcaaggtgttcaacacctacagcaacgaggactacgacagaagaaacgacgaggtggaccccgtggccgccagcgccgagtacgagctggagaagagagtggagaagctggagctgttccccgtggagctggagaaggacgaggacggcctgggcatcagcatcatcggcatgggcgtgggcgccgacgccggcctggagaagctgggcatcttcgtgaagaccgtgaccgagggcggcgccgcccagagagacggcagaatccaggtgaacgaccagatcgtggaggtggacggcatcagcctggtgggcgtgacccagaacttcgccgccaccgtgctgagaaacaccaagggcaacgtgagattcgtgatcggcagagagaagcccggccaggtgagcgaggtggcccagctgatcagccagaccctggagcaggagagaagacagagagagctgctggagcagcactacgcccagtacgacgccgacgacgacgagaccggcgagtacgccaccgacgaggaggaggacgaggtgggccccgtgctgcccggcagcgacatggccatcgaggtgttcgagctgcccgagaacgaggacatgttcagccccagcgagctggacaccagcaagctgagccacaagttcaaggagctgcagatcaagcacgccgtgaccgaggccgagatccagaagctgaagaccaagctgcaggccgccgagaacgagaaggtgagatgggagctggagaagacccagctgcagcagaacatcgaggagaacaaggagagaatgctgaagctggagagctactggatcgaggcccagaccctgtgccacaccgtgaacgagcacctgaaggagacccagagccagtaccaggccctggagaagaagtacaacaaggccaagaagctgatcaaggacttccagcagaaggagctggacttcatcaagagacaggaggccgagagaaagaagatcgaggacctggagaaggcccacctggtggaggtgcagggcctgcaggtgagaatcagagacctggaggccgaggtgttcagactgctgaagcagaacggcacccaggtgaacaacaacaacaacatcttcgagagaagaaccagcctgggcgaggtgagcaagggcgacaccatggagaacctggacggcaagcagaccagctgccaggacggcctgagccaggacctgaacgaggccgtgcccgagaccgagagactggacagcaaggccctgaagaccagagcccagctgagcgtgaagaacagaagacagagacccagcagaaccagactgtacgacagcgtgagcagcaccgacggcgaggacagcctggagagaaagggcctgagaaccagcagccccgagagcgacagcggcgtgccccccctgacccccgtggacagcaacgtgcccttcagcagcgaccacatcgccgagttccaggaggagcccctggaccccgagatgggccccctgagcagcatgtggggcgacaccagcctgttcagcaccagcaagagcgaccacgacgtggaggagagcccctgccaccaccagaccaccaacaagaagatcctgagagagaaggacgacgccaaggaccccaagagcctgagagccagcagcagcctggccgtgcagggcggcaagatcaagagaaagttcgtggacctgggcgcccccctgagaagaaacagcagcaagggcaagaagtggaaggagaaggagaaggaggccagcagattcagcgccggcagcagaatcttcagaggcagactggagaactggacccccaagccctgcagcaccgcccagaccagcaccagaagcccctgcatgcccttcagctggttcaacgacagcagaaagggcagctacagcttcagaaacctgcccgcccccaccagcagcctgcagcccagccccgagaccctgatcagcgacaagaagggcagcaagaacttcaccttcaacgacgacttcagccccagcagcaccagcagcgccgacctgagcggcctgggcgccgagcccaagacccccggcctgagccagagcctggccctgagcagcgacgagatcctggacgacggccagagccccaagcacagccagtgccagaacagagccgtgcaggagtggagcgtgcagcaggtgagccactggctgatgagcctgaacctggagcagtacgtgagcgagttcagcgcccagaacatcaccggcgagcagctgctgcagctggacggcaacaagctgaaggccctgggcatgaccgccagccaggacagagccgtggtgaagaagaagctgaaggagatgaagatgagcctggagaaggccagaaaggcccaggagaagatggagaagcagagagagaagctgagaagaaaggagcaggagcagatgcagagaaagagcaagaagaccgagaagatgaccagcaccaccgccgagggcgccggcgagcagtag

SEQ ID NO: 95335 - DNA, 3297 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggcgagcagaagaccaaggagggcgagggcagccagcagagcagaggcagaaagtacggcagcaacgtgaacagaatcaagaacctgttcatgcagatgggcatggagcccaacgagaacgccgccgtgatcgccaagaccagaggcaagggcggccacagcagcccccagagaagaatgaagcccaaggagttcctggagaagaccgacggcagcgtggtgaagctggagagcagcgtgagcgagagaatcagcagattcgacaccatgtacgacggccccagctacagcaagttcaccgagaccagaaagatgttcgagagaagcgtgcacgagagcggccagaacaacagatacagccccaagaaggagaaggccggcggcagcgagccccaggacgagtggggcggcagcaagagcaacagaggcagcaccgacagcctggacagcctgagcagcagaaccgaggccgtgagccccaccgtgagccagctgagcgccgtgttcgagaacaccgacagccccagcgccatcatcagcgagaaggccgagaacaacgagtacagcgtgaccggccactaccccctgaacctgcccagcgtgaccgtgaccaacctggacaccttcggccacctgaaggacagcaacagctggccccccagcaacaagagaggcgtggacaccgaggacgcccacaagagcaacgccacccccgtgcccgaggtggccagcaagagcaccagcctggccagcatccccggcgaggagatccagcagagcaaggagcccgaggacagcaccagcaaccagcagacccccgacagcatcgacaaggacggccccgaggagccctgcgccgagagcaaggccatgcccaagagcgagatccccagcccccagagccagctgctggaggacgccgaggccaacctggtgggcagagaggccgccaagcagcagagaaaggagctggccggcggcgacttcaccagccccgacgccagcgccagcagctgcggcaaggaggtgcccgaggacagcaacaacttcgacggcagccacgtgtacatgcacagcgactacaacgtgtacagagtgagaagcagatacaacagcgactggggcgagaccggcaccgagcaggacgaggaggaggacagcgacgagaacagctactaccagcccgacatggagtacagcgagatcgtgggcctgcccgaggaggaggagatccccgccaacagaaagatcaagttcagcagcgcccccatcaaggtgttcaacacctacagcaacgaggactacgacagaagaaacgacgaggtggaccccgtggccgccagcgccgagtacgagctggagaagagagtggagaagctggagctgttccccgtggagctggagaaggacgaggacggcctgggcatcagcatcatcggcatgggcgtgggcgccgacgccggcctggagaagctgggcatcttcgtgaagaccgtgaccgagggcggcgccgcccagagagacggcagaatccaggtgaacgaccagatcgtggaggtggacggcatcagcctggtgggcgtgacccagaacttcgccgccaccgtgctgagaaacaccaagggcaacgtgagattcgtgatcggcagagagaagcccggccaggtgagcgaggtggcccagctgatcagccagaccctggagcaggagagaagacagagagagctgctggagcagcactacgcccagtacgacgccgacgacgacgagaccggcgagtacgccaccgacgaggaggaggacgaggtgggccccgtgctgcccggcagcgacatggccatcgaggtgttcgagctgcccgagaacgaggacatgttcagccccagcgagctggacaccagcaagctgagccacaagttcaaggagctgcagatcaagcacgccgtgaccgaggccgagatccagaagctgaagaccaagctgcaggccgccgagaacgagaaggtgagatgggagctggagaagacccagctgcagcagaacatcgaggagaacaaggagagaatgctgaagctggagagctactggatcgaggcccagaccctgtgccacaccgtgaacgagcacctgaaggagacccagagccagtaccaggccctggagaagaagtacaacaaggccaagaagctgatcaaggacttccagcagaaggagctggacttcatcaagagacaggaggccgagagaaagaagatcgaggacctggagaaggcccacctggtggaggtgcagggcctgcaggtgagaatcagagacctggaggccgaggtgttcagactgctgaagcagaacggcacccaggtgaacaacaacaacaacatcttcgagagaagaaccagcctgggcgaggtgagcaagggcgacaccatggagaacctggacggcaagcagaccagctgccaggacggcctgagccaggacctgaacgaggccgtgcccgagaccgagagactggacagcaaggccctgaagaccagagcccagctgagcgtgaagaacagaagacagagacccagcagaaccagactgtacgacagcgtgagcagcaccgacggcgaggacagcctggagagaaagaacttcaccttcaacgacgacttcagccccagcagcaccagcagcgccgacctgagcggcctgggcgccgagcccaagacccccggcctgagccagagcctggccctgagcagcgacgagagcctggacatgatcgacgacgagatcctggacgacggccagagccccaagcacagccagtgccagaacagagccgtgcaggagtggagcgtgcagcaggtgagccactggctgatgagcctgaacctggagcagtacgtgagcgagttcagcgcccagaacatcaccggcgagcagctgctgcagctggacggcaacaagctgaaggccctgggcatgaccgccagccaggacagagccgtggtgaagaagaagctgaaggagatgaagatgagcctggagaaggccagaaaggcccaggagaagatggagaagcagagagagaagctgagaagaaaggagcaggagcagatgcagagaaagagcaagaagaccgagaagatgaccagcaccaccgccgagggcgccggcgagcagtag

SEQ ID NO: 95336 - DNA, 222 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggcgagcagaagaccaaggagggcgagggcagccagcagagcagaggcagaaagtacggcagcaacgtgaacagaatcaagaacctgttcatgcagatgtag

SEQ ID NO: 95337 - DNA, 126 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggctag

SEQ ID NO: 95338 - DNA, 3297 bp, Artificial Sequence; identical to SEQ ID NO: 95335
  Description of Artificial Sequence: Synthetic coding sequence

SEQ ID NO: 95339 - DNA, 3762 bp, Artificial Sequence
  Description of Artificial Sequence: Synthetic coding sequence
atgctgaagaccgagagcagcggcgagagaaccaccctgagaagcgccagcccccacagaaacgcctacagaaccgagttccaggccctgaagagcaccttcgacaagcccaagagcgacggcgagcagaagaccaaggagggcgagggcagccagcagagcagaggcagaaagtacggcagcaacgtgaacagaatcaagaacctgttcatgcagatgggcatggagcccaacgagaacgccgccgtgatcgccaagaccagaggcaagggcggccacagcagcccccagagaagaatgaagcccaaggagttcctggagaagaccgacggcagcgtggtgaagctggagagcagcgtgagcgagagaatcagcagattcgacaccatgtacgacggccccagctacagcaagttcaccgagaccagaaagatgttcgagagaagcgtgcacgagagcggccagaacaacagatacagccccaagaaggagaaggccggcggcagcgagccccaggacgagtggggcggcagcaagagcaacagaggcagcaccgacagcctggacagcctgagcagcagaaccgaggccgtgagccccaccgtgagccagctgagcgccgtgttcgagaacaccgacagccccagcgccatcatcagcgagaaggccgagaacaacgagtacagcgtgaccggccactaccccctgaacctgcccagcgtgaccgtgaccaacctggacaccttcggccacctgaaggacagcaacagctggccccccagcaacaagagaggcgtggacaccgaggacgcccacaagagcaacgccacccccgtgcccgaggtggccagcaagagcaccagcctggccagcatccccggcgaggagatccagcagagcaaggagcccgaggacagcaccagcaaccagcagacccccgacagcatcgacaaggacggccccgaggagccctgcgccgagagcaaggccatgcccaagagcgagatccccagcccccagagccagctgctggaggacgccgaggccaacctggtgggcagagaggccgccaagcagcagagaaaggagctggccggcggcgacttcaccagccccgacgccagcgccagcagctgcggcaaggaggtgcccgaggacagcaacaacttcgacggcagccacgtgtacatgcacagcgactacaacgtgtacagagtgagaagcagatacaacagcgactggggcgagaccggcaccgagcaggacgaggaggaggacagcgacgagaacagctactaccagcccgacatggagtacagcgagatcgtgggcctgcccgaggaggaggagatccccgccaacagaaagatcaagttcagcagcgcccccatcaaggtgttcaacacctacagcaacgaggactacgacagaagaaacgacgaggtggaccccgtggccgccagcgccgagtacgagctggagaagagagtggagaagctggagctgttccccgtggagctggagaaggacgaggacggcctgggcatcagcatcatcggcatgggcgtgggcgccgacgccggcctggagaagctgggcatcttcgtgaagaccgtgaccgagggcggcgccgcccagagagacggcagaatccaggtgaacgaccagatcgtggaggtggacggcatcagcctggtgggcgtgacccagaacttcgccgccaccgtgctgagaaacaccaagggcaacgtgagattcgtgatcggcagagagaagcccggccaggtgagcgaggtggcccagctgatcagccagaccctggagcaggagagaagacagagagagctgctggagcagcactacgcccagtacgacgccgacgacgacgagaccggcgagtacgccaccgacgaggaggaggacgaggtgggccccgtgctgcccggcagcgacatggccatcgaggtgttcgagctgcccgagaacgaggacatgttcagccccagcgagctggacaccagcaagctgagccacaagttcaaggagctgcagatcaagcacgccgtgaccgaggccgagatccagaagctgaagaccaagctgcaggccgccgagaacgagaaggtgagatgggagctggagaagacccagctgcagcagaacatcgaggagaacaaggagagaatgctgaagctggagagctactggatcgaggcccagaccctgtgccacaccgtgaacgagcacctgaaggagacccagagccagtaccaggccctggagaagaagtacaacaaggccaagaagctgatcaaggacttccagcagaaggagctggacttcatcaagagacaggaggccgagagaaagaagatcgaggacctggagaaggcccacctggtggaggtgcagggcctgcaggtgagaatcagagacctggaggccgaggtgttcagactgctgaagcagaacggcacccaggtgaacaacaacaacaacatcttcgagagaagaaccagcctgggcgaggtgagcaagggcgacaccatggagaacctggacggcaagcagaccagctgccaggacggcctgagccaggacctgaacgaggccgtgcccgagaccgagagactggacagcaaggccctgaagaccagagcccagctgagcgtgaagaacagaagacagagacccagcagaaccagactgtacgacagcgtgagcagcaccgacggcgaggacagcctggagagaaagcccagcaacagcttctacaaccacatgcacatcaccaagctgctgccccccaagggcctgagaaccagcagccccgagagcgacagcggcgtgccccccctgacccccgtggacagcaacgtgcccttcagcagcgaccacatcgccgagttccaggaggagcccctggaccccgagatgggccccctgagcagcatgtggggcgacaccagcctgttcagcaccagcaagagcgaccacgacgtggaggagagcccctgccaccaccagaccaccaacaagaagatcctgagagagaaggacgacgccaaggaccccaagagcctgagagccagcagcagcctggccgtgcagggcggcaagatcaagagaaagttcgtggacctgggcgcccccctgagaagaaacagcagcaagggcaagaagtggaaggagaaggagaaggaggccagcagattcagcgccggcagcagaatcttcagaggcagactggagaactggacccccaagccctgcagcaccgcccagaccagcaccagaagcccctgcatgcccttcagctggttcaacgacagcagaaagggcagctacagcttcagaaacctgcccgcccccaccagcagcctgcagcccagccccgagaccctgatcagcgacaagaagggcagcaagaacttcaccttcaacgacgacttcagccccagcagcaccagcagcgccgacctgagcggcctgggcgccgagcccaagacccccggcctgagccagagcctggccctgagcagcgacgaggccctgggcatgaccgccagccaggacagagccgtggtgaagaagaagctgaaggagatgaagatgagcctggagaaggccagaaaggcccaggagaagatggagaagcagagagagaagctgagaagaaaggagcaggagcagatgcagagaaagagcaagaagaccgagaagatgaccagcaccaccgccgagggcgccggcgagcagtag

SEQ ID NO: 95340 - DNA, 930 bp, Artificial Sequence
  Description of Artificial Sequence: Synthetic coding sequence
atggacgagaaggtgttcaccaaggagctggaccagtggatcgagcagctgaacgagtgcaagcagctgagcgagagccaggtgaagagcctgtgcgagaaggccaaggagatcctgaccaaggagagcaacgtgcaggaggtgagatgccccgtgaccgtgtgcggcgacgtgcacggccagttccacgacctgatggagctgttcagaatcggcggcaagagccccgacaccaactacctgttcatgggcgactacgtggacagaggctactacagcgtggagaccgtgaccctgctggtggccctgaaggtgagatacagagagagaatcaccatcctgagaggcaaccacgagagcagacagatcacccaggtgtacggcttctacgacgagtgcctgagaaagtacggcaacgccaacgtgtggaagtacttcaccgacctgttcgactacctgcccctgaccgccctggtggacggccagatcttctgcctgcacggcggcctgagccccagcatcgacaccctggaccacatcagagccctggacagactgcaggaggtgccccacgagggccccatgtgcgacctgctgtggagcgaccccgacgacagaggcggctggggcatcagccccagaggcgccggctacaccttcggccaggacatcagcgagaccttcaaccacgccaacggcctgaccctggtgagcagagcccaccagctggtgatggagggctacaactggtgccacgacagaaacgtggtgaccatcttcagcgcccccaactactgctacagatgcggcaaccaggccgccatcatggagctggacgacaccctgaagtacagcttcctgcagttcgaccccgcccccagaagaggcgagccccacgtgaccagaagaacccccgactacttcctgtag

SEQ ID NO: 95341 - DNA, 1407 bp, Artificial Sequence
  Description of Artificial Sequence: Synthetic coding sequence
atggcccccccccccgccagagtgcacctgggcgccttcctggccgtgacccccaaccccggcagcgccgccagcggcaccgaggccgccgccgccacccccagcaaggtgtggggcagcagcgccggcagaatcgagcccagaggcggcggcagaggcgccctgcccaccagcatgggccagcacggccccagcgccagagccagagccggcagagcccccggccccagacccgccagagaggccagccccagactgagagtgcacaagaccttcaagttcgtggtggtgggcgtgctgctgcaggtggtgcccagcagcgccgccaccatcaagctgcacgaccagagcatcggcacccagcagtgggagcacagccccctgggcgagctgtgcccccccggcagccacagaagcgagcaccccggcgcctgcaacagatgcaccgagggcgtgggctacaccaacgccagcaacaacctgttcgcctgcctgccctgcaccgcctgcaagagcgacgaggaggagagaagcccctgcaccaccaccagaaacaccgcctgccagtgcaagcccggcaccttcagaaacgacaacagcgccgagatgtgcagaaagtgcagcagaggctgccccagaggcatggtgaaggtgaaggactgcaccccctggagcgacatcgagtgcgtgcacaaggagagcggcaacggccacaacatctgggtgatcctggtggtgaccctggtggtgcccctgctgctggtggccgtgctgatcgtgtgctgctgcatcggcagcggctgcggcggcgaccccaagtgcatggacagagtgtgcttctggagactgggcctgctgagaggccccggcgccgaggacaacgcccacaacgagatcctgagcaacgccgacagcctgagcaccttcgtgagcgagcagcagatggagagccaggagcccgccgacctgaccggcgtgaccgtgcagagccccggcgaggcccagtgcctgctgggccccgccgaggccgagggcagccagagaagaagactgctggtgcccgccaacggcgccgaccccaccgagaccctgatgctgttcttcgacaagttcgccaacatcgtgcccttcgacagctgggaccagctgatgagacagctggacctgaccaagaacgagatcgacgtggtgagagccggcaccgccggccccggcgacgccctgtacgccatgctgatgaagtgggtgaacaagaccggcagaaacgccagcatccacaccctgctggacgccctggagagaatggaggagagacacgccagagagaagatccaggacctgctggtggacagcggcaagttcatctacctggaggacggcaccggcagcgccgtgagcctggagtag

SEQ ID NO: 95342 - DNA, 930 bp, Artificial Sequence; identical to SEQ ID NO: 90830
  Description of Artificial Sequence: Synthetic coding sequence

SEQ ID NO: 95343 - DNA, 1461 bp, Artificial Sequence
  Description of Artificial Sequence: Synthetic coding sequence
atgagcagcagcagcccccccgccggcgccgccagcgccgccatcagcgccagcgagaaggtggacggcttcaccagaaagagcgtgagaaaggcccagagacagaagagaagccagggcagcagccagttcagaagccagggcagccaggccgagctgcaccccctgccccagctgaaggacgccaccagcaacgagcagcaggagctgttctgccagaagctgcagcagtgctgcatcctgttcgacttcatggacagcgtgagcgacctgaagagcaaggagatcaagagagccaccctgaacgagctggtggagtacgtgagcaccaacagaggcgtgatcgtggagagcgcctacagcgacatcgtgaagatgatcagcgccaacatcttcagaaccctgccccccagcgacaaccccgacttcgaccccgaggaggacgagcccaccctggaggccagctggccccacatccagctggtgtacgagttcttcctgagattcctggagagccccgacttccagcccagcatcgccaagagatacatcgaccagaagttcgtgcagcagctgctggagctgttcgacagcgaggaccccagagagagagacttcctgaagaccgtgctgcacagaatctacggcaagttcctgggcctgagagccttcatcagaaagcagatcaacaacatcttcctgagattcatctacgagaccgagcacttcaacggcgtggccgagctgctggagatcctgggcagcatcatcaacggcttcgccctgcccctgaaggccgagcacaagcagttcctgatgaaggtgctgatccccatgcacaccgccaagggcctggccctgttccacgcccagctggcctactgcgtggtgcagttcctggagaaggacaccaccctgaccgagcccgtgatcagaggcctgctgaagttctggcccaagacctgcagccagaaggaggtgatgttcctgggcgagatcgaggagatcctggacgtgatcgagcccacccagttcaagaagatcgaggagcccctgttcaagcagatcagcaagtgcgtgagcagcagccacttccaggtggccgagagagccctgtacttctggaacaacgagtacatcctgagcctgatcgaggagaacatcgacaagatcctgcccatcatgttcgccagcctgtacaagatcagcaaggagcactggaaccccaccatcgtggccctggtgtacaacgtgctgaagaccctgatggagatgaacggcaagctgttcgacgacctgaccagcagctacaaggccgagagacagagagagaagaagaaggagctggagagagaggagctgtggaagaagctggaggagctgaagctgaagaaggccctggagaagcagaacagcgcctacaacatgcacagcatcctgagcaacaccagcgccgagtag

SEQ ID NO: 95344 - DNA, 1290 bp, Artificial Sequence
  Description of Artificial Sequence: Synthetic coding sequence
atgatcatgaacgccaccagcaacgagcagcaggagctgttctgccagaagctgcagcagtgctgcatcctgttcgacttcatggacagcgtgagcgacctgaagagcaaggagatcaagagagccaccctgaacgagctggtggagtacgtgagcaccaacagaggcgtgatcgtggagagcgcctacagcgacatcgtgaagatgatcagcgccaacatcttcagaaccctgccccccagcgacaaccccgacttcgaccccgaggaggacgagcccaccctggaggccagctggccccacatccagctggtgtacgagttcttcctgagattcctggagagccccgacttccagcccagcatcgccaagagatacatcgaccagaagttcgtgcagcagctgctggagctgttcgacagcgaggaccccagagagagagacttcctgaagaccgtgctgcacagaatctacggcaagttcctgggcctgagagccttcatcagaaagcagatcaacaacatcttcctgagattcatctacgagaccgagcacttcaacggcgtggccgagctgctggagatcctgggcagcatcatcaacggcttcgccctgcccctgaaggccgagcacaagcagttcctgatgaaggtgctgatccccatgcacaccgccaagggcctggccctgttccacgcccagctggcctactgcgtggtgcagttcctggagaaggacaccaccctgaccgagcccgtgatcagaggcctgctgaagttctggcccaagacctgcagccagaaggaggtgatgttcctgggcgagatcgaggagatcctggacgtgatcgagcccacccagttcaagaagatcgaggagcccctgttcaagcagatcagcaagtgcgtgagcagcagccacttccaggtggccgagagagccctgtacttctggaacaacgagtacatcctgagcctgatcgaggagaacatcgacaagatcctgcccatcatgttcgccagcctgtacaagatcagcaaggagcactggaaccccaccatcgtggccctggtgtacaacgtgctgaagaccctgatggagatgaacggcaagctgttcgacgacctgaccagcagctacaaggccgagagacagagagagaagaagaaggagctggagagagaggagctgtggaagaagctggaggagctgaagctgaagaaggccctggagaagcagaacagcgcctacaacatgcacagcatcctgagcaacaccagcgccgagtag

SEQ ID NO: 95345 - DNA, 1461 bp, Artificial Sequence; identical to SEQ ID NO: 95343
  Description of Artificial Sequence: Synthetic coding sequence

SEQ ID NO: 95346 - DNA, 1341 bp, Artificial Sequence
  Description of Artificial Sequence: Synthetic coding sequence
atgaagtgcttcagcagatacctgccctacatcttcagaccccccaacaccatcctgagcagcagctgccacaccgaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95347 - DNA, 1332 bp, Artificial Sequence
  Description of Artificial Sequence: Synthetic coding sequence
atggaggaggacatcgacaccagaaagatcaacaacagcttcctgagagaccacagctacgccaccgaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95348 - DNA, 1506 bp, Artificial Sequence
  Description of Artificial Sequence: Synthetic coding sequence
atggtgctgcagcccagcgagagacactacagagactggaaccacagaagactgggcccctggtgcagccccaccggcagccccgcccccctgagctgcgagaccggctgcggcgagggcagctggatcctggtgtgcagactgctggtgcccacccaggtgagcctgctgagcatggaggaggacatcgacaccagaaagatcaacaacagcttcctgagagaccacagctacgccaccgaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95349 - DNA, 1299 bp, Artificial Sequence
  Description of Artificial Sequence: Synthetic coding sequence
atgaactaccccgacgagaacacctacggcaacaaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95350 - DNA, 1332 bp, Artificial Sequence; identical to SEQ ID NO: 95347
  Description of Artificial Sequence: Synthetic coding sequence

SEQ ID NO: 95351 - DNA, 1332 bp, Artificial Sequence; identical to SEQ ID NO: 95347
  Description of Artificial Sequence: Synthetic coding sequence

SEQ ID NO: 95352 - DNA, 1530 bp, Artificial Sequence
  Description of Artificial Sequence: Synthetic coding sequence
atgctgctgagcctgcccgccctgcacctgcagaccagcgagcaccaccccttcttccagctgccccacagaagactgggcccctggtgcagccccaccggcagccccgcccccctgagctgcgagaccggctgcggcgagggcagctggatcctggtgtgcagactgctggtgcccacccaggtgagcctgctgagcatggaggaggacatcgacaccagaaagatcaacaacagcttcctgagagaccacagctacgccaccgaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95353 - DNA, 1332 bp, Artificial Sequence; identical to SEQ ID NO: 95347
  Description of Artificial Sequence: Synthetic coding sequence

SEQ ID NO: 95354 - DNA, 1350 bp, Artificial Sequence
  Description of Artificial Sequence: Synthetic coding sequence
atgatccccggcatcggcaccctgacccaggacaccctgtggtgcttcagccaggtgaagggcaccatcgagatcggcaccaccgaggccgacatcatcagcaccgtggagttcaaccacaccggcgagctgctggccaccggcgacaagggcggcagagtggtgatcttccagagagagcaggagagcaagaaccaggtgcacagaagaggcgagtacaacgtgtacagcaccttccagagccacgagcccgagttcgactacctgaagagcctggagatcgaggagaagatcaacaagatcagatggctgccccagcagaacgccgcctacttcctgctgagcaccaacgacaagaccgtgaagctgtggaaggtgagcgagagagacaagagacccgagggctacaacctgaaggacgaggagggcagactgagagaccccgccaccatcaccaccctgagagtgcccgtgctgagacccatggacctgatggtggaggccacccccagaagagtgttcgccaacgcccacacctaccacatcaacagcatcagcgtgaacagcgactacgagacctacatgagcgccgacgacctgagaatcaacctgtggaacttcgagatcaccaaccagagcttcaacatcgtggacatcaagcccgccaacatggaggagctgaccgaggtgatcaccgccgccgagttccacccccaccactgcaacaccttcgtgtacagcagcagcaagggcaccatcagactgtgcgacatgagagccagcgccctgtgcgacagacacaccaagttcttcgaggagcccgaggaccccagcaacagaagcttcttcagcgagatcatcagcagcatcagcgacgtgaagttcagccacagcggcagatacatcatgaccagagactacctgaccgtgaaggtgtgggacctgaacatggagaacagacccatcgagacctaccaggtgcacgactacctgagaagcaagctgtgcagcctgtacgagaacgactgcatcttcgacaagttcgagtgcgtgtggaacggcagcgacagcgtgatcatgaccggcagctacaacaacttcttcagaatgttcgacagaaacaccaagagagacgtgaccctggaggccagcagagagaacagcaagcccagagccatcctgaagcccagaaaggtgtgcgtgggcggcaagagaagaaaggacgagatcagcgtggacagcctggacttcagcaagaagatcctgcacaccgcctggcaccccagcgagaacatcatcgccgtggccgccaccaacaacctgtacatcttccaggacaaggtgaactag

SEQ ID NO: 95355 - DNA, 1299 bp, Artificial Sequence; identical to SEQ ID NO: 95349
  Description of Artificial Sequence: Synthetic coding sequence

SEQ ID NO: 95356 - DNA, 1494 bp, Artificial Sequence
  Description of Artificial Sequence: Synthetic coding sequence
atggagaccaagctgccccccgccagcacccccaccagccccagcagccccggcctgagccccgtgcccccccccgacaaggtggacggcttcagcagaagaagcctgagaagagccagacccagaagaagccacagcagcagccagttcagataccagagcaaccagcaggagctgacccccctgcccctgctgaaggacgtgcccgccagcgagctgcacgagctgctgagcagaaagctggcccagtgcggcgtgatgttcgacttcctggactgcgtggccgacctgaagggcaaggaggtgaagagagccgccctgaacgagctggtggagtgcgtgggcagcaccagaggcgtgctgatcgagcccgtgtaccccgacatcatcagaatgatcagcgtgaacatcttcagaaccctgccccccagcgagaaccccgagttcgaccccgaggaggacgagcccaacctggagcccagctggccccacctgcagctggtgtacgagttcttcctgagattcctggagagccccgacttccagcccagcgtggccaagagatacgtggaccagaagttcgtgctgatgctgctggagctgttcgacagcgaggaccccagagagagagagtacctgaagaccatcctgcacagagtgtacggcaagttcctgggcctgagagcctacatcagaaagcagtgcaaccacatcttcctgagattcatctacgagttcgagcacttcaacggcgtggccgagctgctggagatcctgggcagcatcatcaacggcttcgccctgcccctgaagaccgagcacaagcagttcctggtgagagtgctgatccccctgcacagcgtgaagagcctgagcgtgttccacgcccagctggcctactgcgtggtgcagttcctggagaaggacgccaccctgaccgagcacgtgatcagaggcctgctgaagtactggcccaagacctgcacccagaaggaggtgatgttcctgggcgagatggaggagatcctggacgtgatcgagcccagccagttcgtgaagatccaggagcccctgttcaagcaggtggccagatgcgtgagcagcccccacttccaggtggccgagagagccctgtacttctggaacaacgagtacatcctgagcctgatcgaggacaactgccacaccgtgctgcccgccgtgttcggcaccctgtaccaggtgagcaaggagcactggaaccagaccatcgtgagcctgatctacaacgtgctgaagaccttcatggagatgaacggcaagctgttcgacgagctgaccgccagctacaagctggagaagcagcaggagcagcagaaggcccaggagagacaggagctgtggcagggcctggaggagctgagactgagaagactgcagggcacccagggcgccaaggaggcccccctgcagagactgaccccccaggtggccgccagcggcggccagagctag

SEQ ID NO: 95357 - DNA, 1107 bp, Artificial Sequence
  Description of Artificial Sequence: Synthetic coding sequence
agcgtgcagagccaccccgccccccccagacccagagagaaccccagaggcagcgagagcctgccctgcagactgaccgccatggagaccaagctgccccccgccagcacccccaccagccccagcagccccggcctgagccccgtgcccccccccgacaaggtggacggcttcagcagaagaagcctgagaagagccagacccagaagaagccacagcagcagccagttcagataccagagcaaccagcaggagctgacccccctgcccctgctgaaggacgtgcccgccagcgagctgcacgagctgctgagcagaaagctggcccagtgcggcgtgatgttcgacttcctggactgcgtggccgacctgaagggcaaggaggtgaagagagccgccctgaacgagctggtggagtgcgtgggcagcaccagaggcgtgctgatcgagcccgtgtaccccgacatcatcagaatgatcagcgtgaacatcttcagaaccctgccccccagcgagaaccccgagttcgaccccgaggaggacgagcccaacctggagcccagctggccccacctgcagctggtgtacgagttcttcctgagattcctggagagccccgacttccagcccagcgtggccaagagatacgtggaccagaagttcgtgctgatgctgctggagctgttcgacagcgaggaccccagagagagagagtacctgaagaccatcctgcacagagtgtacggcaagttcctgggcctgagagcctacatcagaaagcagtgcaaccacatcttcctgagattcatctacgagttcgagcacttcaacggcgtggccgagctgctggagatcctgggcagcatcatcaacggcttcgccctgcccctgaagaccgagcacaagcccggcagcagacccgacccccccgccctgtgccaggtggccgtgtgcctgccctgccccgccggcatcctgtgcggcgccgtgcccggcgagggctgccacagcgacagagccagagaccccggcgccgcccagatcctggccaagaacctgcaccccgagggcggcgacgtgagcggcggcgacggcagagacagctag

SEQ ID NO: 95358 - DNA, 582 bp, Artificial Sequence
  Description of Artificial Sequence: Synthetic coding sequence
atggagaccaagctgccccccgccagcacccccaccagccccagcagccccggcctgagccccgtgcccccccccgacaaggtggacggcttcagcagaagaagcctgagaagagccagacccagaagaagccacagcagcagccagttcagataccagagcaaccagcaggagctgacccccctgcccctgctgaaggacgtgcccgccagcgagctgcacgagctgctgagcagaaagctggcccagtgcggcgtgatgttcgacttcctggactgcgtggccgacctgaagggcaaggaggtgaagagagccgccctgaacgagctggtggagtgcgtgggcagcaccagaggcgtgctgatcgagcccgtgtaccccgacatcatcagaatgatcagcgtgaacatcttcagaaccctgccccccagcgagaaccccgagttcgaccccgaggaggacgagcccaacctggagcccagctggccccacctgcagctggtgtacgagttcttcctgagattcctggagagccccgacttccagcccagcgtggccaagagatacgtggaccagaagtag

SEQ ID NO: 95359 - DNA, 1494 bp, Artificial Sequence; identical to SEQ ID NO: 95356
  Description of Artificial Sequence: Synthetic coding sequence

SEQ ID NO: 95360 - DNA, 408 bp, Artificial Sequence
  Description of Artificial Sequence: Synthetic coding sequence
atggaggagctgaccgaggtgatcaccgccgccgagttccacccccaccagtgcaacgtgttcgtgtacagcagcagcaagggcaccatcagactgtgcgacatgagaagcagcgccctgtgcgacagacacagcaagttcttcgaggagcccgaggaccccagcagcagaagcttcttcagcgagatcatcagcagcatcagcgacgtgaagttcagccacagcggcagatacatgatgaccagagaccccgtgggcgagggcgtgggcccccagcacagagccggcagatggagacccaccagaagcaccagcacctgcgccgccagcagcgccctgagcatgagaaccaccgccagcctgaccagcctgagcgtggccggcaccgtgagaatcgcccccagctag

SEQ ID NO: 95361 - DNA, 1269 bp, Artificial Sequence
  Description of Artificial Sequence: Synthetic coding sequence
ctgaccgccgacatcatcagcaccgtggagttcaactacagcggcgacctgctggccaccggcgacaagggcggcagagtggtgatcttccagagagagcaggagaacaagagcagaccccacagcagaggcgagtacaacgtgtacagcaccttccagagccacgagcccgagttcgactacctgaagagcctggagatcgaggagaagatcaacaagatcagatggctgccccagcagaacgccgcccacttcctgctgagcaccaacgacaagaccatcaagctgtggaagatcagcgagagagacaagagagccgagggctacaacctgaaggacgaggacggcagactgagagaccccttcagaatcaccgccctgagagtgcccatcctgaagcccatggacctgatggtggaggccagccccagaagaatcttcgccaacgcccacacctaccacatcaacagcatcagcgtgaacagcgaccacgagacctacctgagcgccgacgacctgagaatcaacctgtggcacctggagatcaccgacagaagcttcaacatcgtggacatcaagcccgccaacatggaggagctgaccgaggtgatcaccgccgccgagttccacccccaccagtgcaacgtgttcgtgtacagcagcagcaagggcaccatcagactgtgcgacatgagaagcagcgccctgtgcgacagacacagcaagttcttcgaggagcccgaggaccccagcagcagaagcttcttcagcgagatcatcagcagcatcagcgacgtgaagttcagccacagcggcagatacatgatgaccagagactacctgagcgtgaaggtgtgggacctgaacatggagagcagacccgtggagacccaccaggtgcacgagtacctgagaagcaagctgtgcagcctgtacgagaacgactgcatcttcgacaagttcgagtgctgctggaacggcagcgacagcgccatcatgaccggcagctacaacaacttcttcagaatgttcgacagagacaccagaagagacgtgaccctggaggccagcagagagagcagcaagcccagagccagcctgaagcccagaaaggtgtgcaccggcggcaagagaagaaaggacgagatcagcgtggacagcctggacttcaacaagaagatcctgcacaccgcctggcaccccgtggacaacgtgatcgccgtggccgccaccaacaacctgtacatcttccaggacaagatcaactag

SEQ ID NO: 95362 - DNA, 1713 bp, Artificial Sequence
  Description of Artificial Sequence: Synthetic coding sequence
atgccctacaagctgaagaaggagaaggagccccccaaggtggccaagtgcaccgccaagcccagcagcagcggcaaggacggcggcggcgagaacaccgaggaggcccagccccagccccagccccagccccagccccaggcccagagccagccccccagcagcaacaagagacccagcaacagcacccccccccccacccagctgagcaagatcaagtacagcggcggcccccagatcgtgaagaaggagctgttcatccagaagctgagacagtgctgcgtgctgttcgacttcgtgagcgaccccctgagcgacctgaagttcaaggaggtgaagagagccggcctgaacgagatggtggagtacatcacccacagcagagacgtggtgaccgaggccatctaccccgaggccgtgaccatgttcagcgtgaacctgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctggccctgctggacctgttcgacagcgaggaccccagagagagagacttcctgaagaccatcctgcacagaatctacggcaagttcctgggcctgagagcctacatcagaagacagatcaaccacatcttctacagattcatctacgagaccgagcaccacaacggcatcgccgagctgctggagatcctgggcagcatcatcaacggcttcgccctgcccctgaaggaggagcacaagatgttcctgatcagagtgctgctgcccctgcacaaggtgaagagcctgagcgtgtaccacccccagctggcctactgcgtggtgcagttcctggagaaggagagcagcctgaccgagcccgtgatcgtgggcctgctgaagttctggcccaagacccacagccccaaggaggtgatgttcctgaacgagctggaggagatcctggacgtgatcgagcccagcgagttcagcaaggtgatggagcccctgttcagacagctggccaagtgcgtgagcagcccccacttccaggtggccgagagagccctgtactactggaacaacgagtacatcatgagcctgatcagcgacaacgccgccagagtgctgcccatcatgttccccgccctgtacagaaacagcaagagccactggaacaagaccatccacggcctgatctacaacgccctgaagctgttcatggagatgaaccagaagctgttcgacgactgcacccagcagtacaaggccgagaagcagaagggcagattcagaatgaaggagagagaggagatgtggcagaagatcgaggagctggccagactgaacccccagtaccccatgttcagagcccccccccccctgccccccgtgtacagcatggagaccgagacccccaccgccgaggacatccagctgctgaagagaaccgtggagaccgaggccgtgcagatgctgaaggacatcaagaaggagaaggtgctgctgagaagaaagagcgagctgccccaggacgtgtacaccatcaaggccctggaggcccacaagagagccgaggagttcctgaccgccagccaggaggccctgtag

SEQ ID NO: 95363 - DNA, 1491 bp, Artificial Sequence
  Description of Artificial Sequence: Synthetic coding sequence
atgccctacaagctgaagaaggagaaggagctgttcatccagaagctgagacagtgctgcgtgctgttcgacttcgtgagcgaccccctgagcgacctgaagttcaaggaggtgaagagagccggcctgaacgagatggtggagtacatcacccacagcagagacgtggtgaccgaggccatctaccccgaggccgtgaccatgttcagcgtgaacctgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctggccctgctggacctgttcgacagcgaggaccccagagagagagacttcctgaagaccatcctgcacagaatctacggcaagttcctgggcctgagagcctacatcagaagacagatcaaccacatcttctacagattcatctacgagaccgagcaccacaacggcatcgccgagctgctggagatcctgggcagcatcatcaacggcttcgccctgcccctgaaggaggagcacaagatgttcctgatcagagtgctgctgcccctgcacaaggtgaagagcctgagcgtgtaccacccccagctggcctactgcgtggtgcagttcctggagaaggagagcagcctgaccgagcccgtgatcgtgggcctgctgaagttctggcccaagacccacagccccaaggaggtgatgttcctgaacgagctggaggagatcctggacgtgatcgagcccagcgagttcagcaaggtgatggagcccctgttcagacagctggccaagtgcgtgagcagcccccacttccaggtggccgagagagccctgtactactggaacaacgagtacatcatgagcctgatcagcgacaacgccgccagagtgctgcccatcatgttccccgccctgtacagaaacagcaagagccactggaacaagaccatccacggcctgatctacaacgccctgaagctgttcatggagatgaaccagaagctgttcgacgactgcacccagcagtacaaggccgagaagcagaagggcagattcagaatgaaggagagagaggagatgtggcagaagatcgaggagctggccagactgaacccccagtaccccatgttcagagcccccccccccctgccccccgtgtacagcatggagaccgagacccccaccgccgaggacatccagctgctgaagagaaccgtggagaccgaggccgtgcagatgctgaaggacatcaagaaggagaaggtgctgctgagaagaaagagcgagctgccccaggacgtgtacaccatcaaggccctggaggcccacaagagagccgaggagttcctgaccgccagccaggaggccctgtag

SEQ ID NO: 95364 - DNA, 1515 bp, Artificial Sequence
  Description of Artificial Sequence: Synthetic coding sequence
tgaaagaaggagagaagacagagcagcagcagattcaacctgagcaagaacagagagctgcagaagctgcccgccctgaaggacagccccacccaggagagagaggagctgttcatccagaagctgagacagtgctgcgtgctgttcgacttcgtgagcgaccccctgagcgacctgaagttcaaggaggtgaagagagccggcctgaacgagatggtggagtacatcacccacagcagagacgtggtgaccgaggccatctaccccgaggccgtgaccatgttcagcgtgaacctgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctggccctgctggacctgttcgacagcgaggaccccagagagagagacttcctgaagaccatcctgcacagaatctacggcaagttcctgggcctgagagcctacatcagaagacagatcaaccacatcttctacagattcatctacgagaccgagcaccacaacggcatcgccgagctgctggagatcctgggcagcatcatcaacggcttcgccctgcccctgaaggaggagcacaagatgttcctgatcagagtgctgctgcccctgcacaaggtgaagagcctgagcgtgtaccacccccaggtgatcgtgggcctgctgaagttctggcccaagacccacagccccaaggaggtgatgttcctgaacgagctggaggagatcctggacgtgatcgagcccagcgagttcagcaaggtgatggagcccctgttcagacagctggccaagtgcgtgagcagcccccacttccaggtggccgagagagccctgtactactggaacaacgagtacatcatgagcctgatcagcgacaacgccgccagagtgctgcccatcatgttccccgccctgtacagaaacagcaagagccactggaacaagaccatccacggcctgatctacaacgccctgaagctgttcatggagatgaaccagaagctgttcgacgactgcacccagcagtacaaggccgagaagcagaagggcagattcagaatgaaggagagagaggagatgtggcagaagatcgaggagctggccagactgaacccccagtaccccatgttcagagcccccccccccctgccccccgtgtacagcatggagaccgagacccccaccgccgaggacatccagctgctgaagagaaccgtggagaccgaggccgtgcagatgctgaaggacatcaagaaggagaaggtgctgctgagaagaaagagcgagctgccccaggacgtgtacaccatcaaggccctggaggcccacaagagagccgaggagttcctgaccgccagccaggaggccctgtag

SEQ ID NO: 95365 - DNA, 1809 bp, Artificial Sequence
  Description of Artificial Sequence: Synthetic coding sequence
atgccctacaagctgaagaaggagaaggagccccccaaggtggccaagtgcaccgccaagcccagcagcagcggcaaggacggcggcggcgagaacaccgaggaggcccagccccagccccagccccagccccagccccaggcccagagccagccccccagcagcaacaagagacccagcaacagcacccccccccccacccagctgagcaagatcaagtacagcggcggcccccagatcgtgaagaaggagagaagacagagcagcagcagattcaacctgagcaagaacagagagctgcagaagctgcccgccctgaaggacagccccacccaggagagagaggagctgttcatccagaagctgagacagtgctgcgtgctgttcgacttcgtgagcgaccccctgagcgacctgaagttcaaggaggtgaagagagccggcctgaacgagatggtggagtacatcacccacagcagagacgtggtgaccgaggccatctaccccgaggccgtgaccatgttcagcgtgaacctgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctggccctgctggacctgttcgacagcgaggaccccagagagagagacttcctgaagaccatcctgcacagaatctacggcaagttcctgggcctgagagcctacatcagaagacagatcaaccacatcttctacagattcatctacgagaccgagcaccacaacggcatcgccgagctgctggagatcctgggcagcatcatcaacggcttcgccctgcccctgaaggaggagcacaagatgttcctgatcagagtgctgctgcccctgcacaaggtgaagagcctgagcgtgtaccacccccagctggcctactgcgtggtgcagttcctggagaaggagagcagcctgaccgagcccgtgatcgtgggcctgctgaagttctggcccaagacccacagccccaaggaggtgatgttcctgaacgagctggaggagatcctggacgtgatcgagcccagcgagttcagcaaggtgatggagcccctgttcagacagctggccaagtgcgtgagcagcccccacttccaggtggccgagagagccctgtactactggaacaacgagtacatcatgagcctgatcagcgacaacgccgccagagtgctgcccatcatgttccccgccctgtacagaaacagcaagagccactggaacaagaccatccacggcctgatctacaacgccctgaagctgttcatggagatgaaccagaagctgttcgacgactgcacccagcagtacaaggccgagaagcagaagggcagattcagaatgaaggagagagaggagatgtggcagaagatcgaggagctggccagactgaacccccagtaccccatgttcagagcccccccccccctgccccccgtgtacagcatggagaccgagacccccaccgccgaggacatccagctgctgaagagaaccgtggagaccgaggccgtgcagatgctgaaggacatcaagaaggagaaggtgctgctgagaagaaagagcgagctgccccaggacgtgtacaccatcaaggccctggaggcccacaagagagccgaggagttcctgaccgccagccaggaggccctgtag

SEQ ID NO: 95366 - DNA, 1755 bp, Artificial Sequence
  Description of Artificial Sequence: Synthetic coding sequence
atgccctacaagctgaagaaggagaaggagccccccaaggtggccaagtgcaccgccaagcccagcagcagcggcaaggacggcggcggcgagaacaccgaggaggcccagccccagccccagccccagccccagccccaggcccagagccagccccccagcagcaacaagagacccagcaacagcacccccccccccacccagctgagcaagatcaagtacagcggcggcccccagatcgtgaagaaggagagaagacagagcagcagcagattcaacctgagcaagaacagagagctgcagaagctgcccgccctgaaggacagccccacccaggagagagaggagctgttcatccagaagctgagacagtgctgcgtgctgttcgacttcgtgagcgaccccctgagcgacctgaagttcaaggaggtgaagagagccggcctgaacgagatggtggagtacatcacccacagcagagacgtggtgaccgaggccatctaccccgaggccgtgaccatgttcagcgtgaacctgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctggccctgctggacctgttcgacagcgaggaccccagagagagagacttcctgaagaccatcctgcacagaatctacggcaagttcctgggcctgagagcctacatcagaagacagatcaaccacatcttctacagattcatctacgagaccgagcaccacaacggcatcgccgagctgctggagatcctgggcagcatcatcaacggcttcgccctgcccctgaaggaggagcacaagatgttcctgatcagagtgctgctgcccctgcacaaggtgaagagcctgagcgtgtaccacccccaggtgatcgtgggcctgctgaagttctggcccaagacccacagccccaaggaggtgatgttcctgaacgagctggaggagatcctggacgtgatcgagcccagcgagttcagcaaggtgatggagcccctgttcagacagctggccaagtgcgtgagcagcccccacttccaggtggccgagagagccctgtactactggaacaacgagtacatcatgagcctgatcagcgacaacgccgccagagtgctgcccatcatgttccccgccctgtacagaaacagcaagagccactggaacaagaccatccacggcctgatctacaacgccctgaagctgttcatggagatgaaccagaagctgttcgacgactgcacccagcagtacaaggccgagaagcagaagggcagattcagaatgaaggagagagaggagatgtggcagaagatcgaggagctggccagactgaacccccagtaccccatgttcagagcccccccccccctgccccccgtgtacagcatggagaccgagacccccaccgccgaggacatccagctgctgaagagaaccgtggagaccgaggccgtgcagatgctgaaggacatcaagaaggagaaggtgctgctgagaagaaagagcgagctgccccaggacgtgtacaccatcaaggccctggaggcccacaagagagccgaggagttcctgaccgccagccaggaggccctgtag

SEQ ID NO: 95367 - DNA, 1404 bp, Artificial Sequence
  Description of Artificial Sequence: Synthetic coding sequence
atgagcagcgcccccaccaccccccccagcgtggacaaggtggacggcttcagcagaaagagcgtgagaaaggccagacagaagagaagccagagcagcagccagttcagaagccagggcaagcccatcgagctgacccccctgcccctgctgaaggacgtgcccagcagcgagcagcccgagctgttcctgaagaagctgcagcagtgctgcgtgatcttcgacttcatggacaccctgagcgacctgaagatgaaggagtacaagagaagcaccctgaacgagctggtggactacatcaccatcagcagaggctgcctgaccgagcagacctaccccgaggtggtgagaatggtgagctgcaacatcttcagaaccctgccccccagcgacagcaacgagttcgaccccgaggaggacgagcccaccctggaggccagctggccccacctgcagctggtgtacgagttcttcatcagattcctggagagccaggagttccagcccagcatcgccaagaagtacatcgaccagaagttcgtgctgcagctgctggagctgttcgacagcgaggaccccagagagagagactacctgaagaccgtgctgcacagaatctacggcaagttcctgggcctgagagccttcatcagaaagcagatcaacaacatcttcctgagattcgtgtacgagaccgagcacttcaacggcgtggccgagctgctggagatcctgggcagcatcatcaacggcttcgccctgcccctgaaggccgagcacaagcagttcctggtgaaggtgctgatccccctgcacaccgtgagaagcctgagcctgttccacgcccagctggcctactgcatcgtgcagttcctggagaaggaccccagcctgaccgagcccgtgatcagaggcctgatgaagttctggcccaagacctgcagccagaaggaggtgatgttcctgggcgagctggaggagatcctggacgtgatcgagcccagccagttcgtgaagatccaggagcccctgttcaagcagatcgccaagtgcgtgagcagcccccacttccaggtggccgagagagccctgtactactggaacaacgagtacatcatgagcctgatcgaggagaacagcaacgtgatcctgcccatcatgttcagcagcctgtacagaatcagcaaggagcactggaaccccgccatcgtggccctggtgtacaacgtgctgaaggccttcatggagatgaacagcaccatgttcgacgagctgaccgccacctacaagagcgacagacagagagagaagaagaaggagaaggagagagaggagctgtggaagaagctggaggacctggagctgaagagaggcctgagaagagacggcatcatccccacctag

SEQ ID NO: 95368 - DNA, 1176 bp, Artificial Sequence
  Description of Artificial Sequence: Synthetic coding sequence
atggacaccctgagcgacctgaagatgaaggagtacaagagaagcaccctgaacgagctggtggactacatcaccatcagcagaggctgcctgaccgagcagacctaccccgaggtggtgagaatggtgagctgcaacatcttcagaaccctgccccccagcgacagcaacgagttcgaccccgaggaggacgagcccaccctggaggccagctggccccacctgcagctggtgtacgagttcttcatcagattcctggagagccaggagttccagcccagcatcgccaagaagtacatcgaccagaagttcgtgctgcagctgctggagctgttcgacagcgaggaccccagagagagagactacctgaagaccgtgctgcacagaatctacggcaagttcctgggcctgagagccttcatcagaaagcagatcaacaacatcttcctgagattcgtgtacgagaccgagcacttcaacggcgtggccgagctgctggagatcctgggcagcatcatcaacggcttcgccctgcccctgaaggccgagcacaagcagttcctggtgaaggtgctgatccccctgcacaccgtgagaagcctgagcctgttccacgcccagctggcctactgcatcgtgcagttcctggagaaggaccccagcctgaccgagcccgtgatcagaggcctgatgaagttctggcccaagacctgcagccagaaggaggtgatgttcctgggcgagctggaggagatcctggacgtgatcgagcccagccagttcgtgaagatccaggagcccctgttcaagcagatcgccaagtgcgtgagcagcccccacttccaggtggccgagagagccctgtactactggaacaacgagtacatcatgagcctgatcgaggagaacagcaacgtgatcctgcccatcatgttcagcagcctgtacagaatcagcaaggagcactggaaccccgccatcgtggccctggtgtacaacgtgctgaaggccttcatggagatgaacagcaccatgttcgacgagctgaccgccacctacaagagcgacagacagagagagaagaagaaggagaaggagagagaggagctgtggaagaagctggaggacctggagctgaagagaggcctgagaagagacggcatcatccccacctag

SEQ ID NO: 95369 - DNA, 1389 bp, Artificial Sequence
  Description of Artificial Sequence: Synthetic coding sequence
atgagcagcgcccccaccaccccccccagcgtggacaaggtggacggcttcagcagaaagagcgtgagaaaggccagacagaagagaagccagagcagcagccagttcagaagccagggcaagcccatcgagctgacccccctgcccctgctgaaggacgtgcccagcagcgagcagcccgagctgttcctgaagaagctgcagcagtgctgcgtgatcttcgacttcatggacaccctgagcgacctgaagatgaaggagtacaagagaagcaccctgaacgagctggtggactacatcaccatcagcagaggctgcctgaccgagcagacctaccccgaggtggtgagaatggtgagctgcaacatcttcagaaccctgccccccagcgacagcaacgagttcgaccccgaggaggacgagcccaccctggaggccagctggccccacctgcagctggtgtacgagttcttcatcagattcctggagagccaggagttccagcccagcatcgccaagaagtacatcgaccagaagttcgtgctgcagctgctggagctgttcgacagcgaggaccccagagagagagactacctgaagaccgtgctgcacagaatctacggcaagttcctgggcctgagagccttcatcagaaagcagatcaacaacatcttcctgagattcgtgtacgagaccgagcacttcaacggcgtggccgagctgctggagatcctgggcagcatcatcaacggcttcgccctgcccctgaaggccgagcacaagcagttcctggtgaaggtgctgatccccctgcacaccgtgagaagcctgagcctgttccacgcccagctggcctactgcatcgtgcagttcctggagaaggaccccagcctgaccgagcccgtgatcagaggcctgatgaagttctggcccaagacctgcagccagaaggaggtgatgttcctgggcgagctggaggagatcctggacgtgatcgagcccagccagttcgtgaagatccaggagcccctgttcaagcagatcgccaagtgcgtgagcagcccccacttccaggtggccgagagagccctgtactactggaacaacgagtacatcatgagcctgatcgaggagaacagcaacgtgatcctgcccatcatgttcagcagcctgtacagaatcagcaaggagcactggaaccccgccatcgtggccctggtgtacaacgtgctgaaggccttcatggagatgaacagcaccatgttcgacgagctgaccgccacctacaacgagaagaagaaggagaaggagagagaggagctgtggaagaagctggaggacctggagctgaagagaggcctgagaagagacggcatcatccccacctag

SEQ ID NO: 95370 - DNA, 1344 bp, Artificial Sequence
  Description of Artificial Sequence: Synthetic coding sequence
atgggcctgagcttcttcagcaagcacctgcccatccaggagggccagccctgggccctgaagacccccgccgacatcatcagcaccgtggagttcaaccacaccggcgagctgctggccaccggcgacaagggcggcagagtggtgatcttccagagagagcccgagagcaagaacgccccccacagccagggcgagtacgacgtgtacagcaccttccagagccacgagcccgagttcgactacctgaagagcctggagatcgaggagaagatcaacaagatcaagtggctgccccagcagaacgccgcccacagcctgctgagcaccaacgacaagaccatcaagctgtggaagatcaccgagagagacaagagacccgagggctacaacctgaaggacgaggagggcaagctgaaggacctgagcaccgtgaccagcctgcaggtgcccgtgctgaagcccatggacctgatggtggaggtgagccccagaagaatcttcgccaacggccacacctaccacatcaacagcatcagcgtgaacagcgactgcgagacctacatgagcgccgacgacctgagaatcaacctgtggcacctggccatcaccgacagaagcttcaacatcgtggacatcaagcccgccaacatggaggacctgaccgaggtgatcaccgccagcgagttccacccccaccactgcaacctgttcgtgtacagcagcagcaagggcagcctgagactgtgcgacatgagagccgccgccctgtgcgacaagcacagcaagctgttcgaggagcccgaggaccccagcaacagaagcttcttcagcgagatcatcagcagcgtgagcgacgtgaagttcagccacagcggcagatacatgctgaccagagactacctgaccgtgaaggtgtgggacctgaacatggaggccagacccatcgagacctaccaggtgcacgactacctgagaagcaagctgtgcagcctgtacgagaacgactgcatcttcgacaagttcgagtgcgcctggaacggcagcgacagcgtgatcatgaccggcgcctacaacaacttcttcagaatgttcgacagaaacaccaagagagacgtgaccctggaggccagcagagagagcagcaagcccagagccgtgctgaagcccagaagagtgtgcgtgggcggcaagagaagaagagacgacatcagcgtggacagcctggacttcaccaagaagatcctgcacaccgcctggcaccccgccgagaacatcatcgccatcgccgccaccaacaacctgtacatcttccaggacaaggtgaacagcgacatgcactag

SEQ ID NO: 95371 - DNA, 1344 bp, Artificial Sequence
  Description of Artificial Sequence: Synthetic coding sequence
atgggcgaggacaccgacaccagaaagatcaaccacagcttcctgagagaccacagctacgtgaccgaggccgacatcatcagcaccgtggagttcaaccacaccggcgagctgctggccaccggcgacaagggcggcagagtggtgatcttccagagagagcccgagagcaagaacgccccccacagccagggcgagtacgacgtgtacagcaccttccagagccacgagcccgagttcgactacctgaagagcctggagatcgaggagaagatcaacaagatcaagtggctgccccagcagaacgccgcccacagcctgctgagcaccaacgacaagaccatcaagctgtggaagatcaccgagagagacaagagacccgagggctacaacctgaaggacgaggagggcaagctgaaggacctgagcaccgtgaccagcctgcaggtgcccgtgctgaagcccatggacctgatggtggaggtgagccccagaagaatcttcgccaacggccacacctaccacatcaacagcatcagcgtgaacagcgactgcgagacctacatgagcgccgacgacctgagaatcaacctgtggcacctggccatcaccgacagaagcttcaacatcgtggacatcaagcccgccaacatggaggacctgaccgaggtgatcaccgccagcgagttccacccccaccactgcaacctgttcgtgtacagcagcagcaagggcagcctgagactgtgcgacatgagagccgccgccctgtgcgacaagcacagcaagctgttcgaggagcccgaggaccccagcaacagaagcttcttcagcgagatcatcagcagcgtgagcgacgtgaagttcagccacagcggcagatacatgctgaccagagactacctgaccgtgaaggtgtgggacctgaacatggaggccagacccatcgagacctaccaggtgcacgactacctgagaagcaagctgtgcagcctgtacgagaacgactgcatcttcgacaagttcgagtgcgcctggaacggcagcgacagcgtgatcatgaccggcgcctacaacaacttcttcagaatgttcgacagaaacaccaagagagacgtgaccctggaggccagcagagagagcagcaagcccagagccgtgctgaagcccagaagagtgtgcgtgggcggcaagagaagaagagacgacatcagcgtggacagcctggacttcaccaagaagatcctgcacaccgcctggcaccccgccgagaacatcatcgccatcgccgccaccaacaacctgtacatcttccaggacaaggtgaacagcgacatgcactag

SEQ ID NO: 95372 - DNA, 1323 bp, Artificial Sequence
  Description of Artificial Sequence: Synthetic coding sequence
atgagagaggccgacaccctgagacccccccagctgatggaggtgagcgccgacatcatcagcaccgtggagttcaaccacaccggcgagctgctggccaccggcgacaagggcggcagagtggtgatcttccagagagagcccgagagcaagaacgccccccacagccagggcgagtacgacgtgtacagcaccttccagagccacgagcccgagttcgactacctgaagagcctggagatcgaggagaagatcaacaagatcaagtggctgccccagcagaacgccgcccacagcctgctgagcaccaacgacaagaccatcaagctgtggaagatcaccgagagagacaagagacccgagggctacaacctgaaggacgaggagggcaagctgaaggacctgagcaccgtgaccagcctgcaggtgcccgtgctgaagcccatggacctgatggtggaggtgagccccagaagaatcttcgccaacggccacacctaccacatcaacagcatcagcgtgaacagcgactgcgagacctacatgagcgccgacgacctgagaatcaacctgtggcacctggccatcaccgacagaagcttcaacatcgtggacatcaagcccgccaacatggaggacctgaccgaggtgatcaccgccagcgagttccacccccaccactgcaacctgttcgtgtacagcagcagcaagggcagcctgagactgtgcgacatgagagccgccgccctgtgcgacaagcacagcaagctgttcgaggagcccgaggaccccagcaacagaagcttcttcagcgagatcatcagcagcgtgagcgacgtgaagttcagccacagcggcagatacatgctgaccagagactacctgaccgtgaaggtgtgggacctgaacatggaggccagacccatcgagacctaccaggtgcacgactacctgagaagcaagctgtgcagcctgtacgagaacgactgcatcttcgacaagttcgagtgcgcctggaacggcagcgacagcgtgatcatgaccggcgcctacaacaacttcttcagaatgttcgacagaaacaccaagagagacgtgaccctggaggccagcagagagagcagcaagcccagagccgtgctgaagcccagaagagtgtgcgtgggcggcaagagaagaagagacgacatcagcgtggacagcctggacttcaccaagaagatcctgcacaccgcctggcaccccgccgagaacatcatcgccatcgccgccaccaacaacctgtacatcttccaggacaaggtgaacagcgacatgcactag

SEQ ID NO: 95373 - DNA, 1323 bp, Artificial Sequence; identical to SEQ ID NO: 95372
  Description of Artificial Sequence: Synthetic coding sequence

SEQ ID NO: 95374 - DNA, 1293 bp, Artificial Sequence
  Description of Artificial Sequence: Synthetic coding sequence
atgggcaagagagacaccgccgacatcatcagcaccgtggagttcaaccacaccggcgagctgctggccaccggcgacaagggcggcagagtggtgatcttccagagagagcccgagagcaagaacgccccccacagccagggcgagtacgacgtgtacagcaccttccagagccacgagcccgagttcgactacctgaagagcctggagatcgaggagaagatcaacaagatcaagtggctgccccagcagaacgccgcccacagcctgctgagcaccaacgacaagaccatcaagctgtggaagatcaccgagagagacaagagacccgagggctacaacctgaaggacgaggagggcaagctgaaggacctgagcaccgtgaccagcctgcaggtgcccgtgctgaagcccatggacctgatggtggaggtgagccccagaagaatcttcgccaacggccacacctaccacatcaacagcatcagcgtgaacagcgactgcgagacctacatgagcgccgacgacctgagaatcaacctgtggcacctggccatcaccgacagaagcttcaacatcgtggacatcaagcccgccaacatggaggacctgaccgaggtgatcaccgccagcgagttccacccccaccactgcaacctgttcgtgtacagcagcagcaagggcagcctgagactgtgcgacatgagagccgccgccctgtgcgacaagcacagcaagctgttcgaggagcccgaggaccccagcaacagaagcttcttcagcgagatcatcagcagcgtgagcgacgtgaagttcagccacagcggcagatacatgctgaccagagactacctgaccgtgaaggtgtgggacctgaacatggaggccagacccatcgagacctaccaggtgcacgactacctgagaagcaagctgtgcagcctgtacgagaacgactgcatcttcgacaagttcgagtgcgcctggaacggcagcgacagcgtgatcatgaccggcgcctacaacaacttcttcagaatgttcgacagaaacaccaagagagacgtgaccctggaggccagcagagagagcagcaagcccagagccgtgctgaagcccagaagagtgtgcgtgggcggcaagagaagaagagacgacatcagcgtggacagcctggacttcaccaagaagatcctgcacaccgcctggcaccccgccgagaacatcatcgccatcgccgccaccaacaacctgtacatcttccaggacaaggtgaacagcgacatgcactag

SEQ ID NO: 95375 - DNA, 1623 bp, Artificial Sequence
  Description of Artificial Sequence: Synthetic coding sequence
atgcccaacaagaacaagaaggagaaggagagccccaaggccggcaagagcggcaagagcagcaaggagggccaggacaccgtggagagcgagcagatcagcgtgagaaagaacagcctggtggccgtgcccagcaccgtgagcgccaagatcaaggtgcccgtgagccagcccatcgtgaagaaggacaagagacagaacagcagcagattcagcgccagcaacaacagagagctgcagaagctgcccagcctgaaggacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccaggcccagaaggaccccaagaaggacagacccctggccagaagaaagagcgagctgccccaggacccccacaccaagaaggccctggaggcccactgcagagccgacgagctggccagccaggacggcagatag

SEQ ID NO: 95376 - DNA, 1575 bp, Artificial Sequence
  Description of Artificial Sequence: Synthetic coding sequence
atgctgacctgcaacaaggccggcagcagaatggtggtggacgccgccaacagcaacggccccttccagcccgtggtgctgctgcacatcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccagtacaccgtgtacagccaggccagcaccatgagcatccccgtggccatggagaccgacggccccctgttcgaggacgtgcagatgctgagaaagaccgtgaaggacgaggcccaccaggcccagaaggaccccaagaaggacagacccctggccagaagaaagagcgagctgccccaggacccccacaccaagaaggccctggaggcccactgcagagccgacgagctggccagccaggacggcagatag

SEQ ID NO: 95377 - DNA, 783 bp, Artificial Sequence
  Description of Artificial Sequence: Synthetic coding sequence
atgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggacaacacctggctggacatccagagacccgaggccctgcacggcgacgagcccaaggccatctag

SEQ ID NO: 95378 - DNA, 1458 bp, Artificial Sequence
  Description of Artificial Sequence: Synthetic coding sequence
atgctgacctgcaacaaggccggcagcagaatggtggtggacgccgccaacagcaacggccccttccagcccgtggtgctgctgcacatcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccaggcccagaaggaccccaagaaggacagacccctggccagaagaaagagcgagctgccccaggacccccacaccaagaaggccctggaggcccactgcagagccgacgagctggccagccaggacggcagatag

SEQ ID NO: 95379 - DNA, 1668 bp, Artificial Sequence
  Description of Artificial Sequence: Synthetic coding sequence
atgcccaacaagaacaagaaggagaaggagagccccaaggccggcaagagcggcaagagcagcaaggagggccaggacaccgtggagagcgagggcaccagccccgaggagcccagcagccccaaggtgcccccccccctgctgcccgagctgctggtgctgatcttcggcggcctgcagggcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccagtacaccgtgtacagccaggccagcaccatgagcatccccgtggccatggagaccgacggccccctgttcgaggacgtgcagatgctgagaaagaccgtgaaggacgaggcccaccaggcccagaaggaccccaagaaggacagacccctggccagaagaaagagcgagctgccccaggacccccacaccaagaaggccctggaggcccactgcagagccgacgagctggccagccaggacggcagatag

SEQ ID NO: 95380 - DNA, 1350 bp, Artificial Sequence
  Description of Artificial Sequence: Synthetic coding sequence
atgctgacctgcaacaaggccggcagcagaatggtggtggacgccgccaacagcaacggccccttccagcccgtggtgctgctgcacatcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccaggtgctgaagaagagaatcacctag

SEQ ID NO: 95381 - DNA, 1155 bp, Artificial Sequence
  Description of Artificial Sequence: Synthetic coding sequence
atgctgacctgcaacaaggccggcagcagaatggtggtggacgccgccaacagcaacggccccttccagcccgtggtgctgctgcacatcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagtag

SEQ ID NO: 95382 - DNA, 1662 bp, Artificial Sequence
  Description of Artificial Sequence: Synthetic coding sequence
aacaagaacaagaaggagaaggagagccccaaggccggcaagagcggcaagagcagcaaggagggccaggacaccgtggagagcgagggcaccagccccgaggagcccagcagccccaaggtgcccccccccctgctgcccgagctgctggtgctgatcttcggcggcctgcagggcagagacgtgccccccgccgaccaggagaagctgttcatccagaagctgagacagtgctgcgtgctgttcgacttcgtgagcgaccccctgagcgacctgaagtggaaggaggtgaagagagccgccctgagcgagatggtggagtacatcacccacaacagaaacgtgatcaccgagcccatctaccccgaggtggtgcacatgttcgccgtgaacatgttcagaaccctgccccccagcagcaaccccaccggcgccgagttcgaccccgaggaggacgagcccaccctggaggccgcctggccccacctgcagctggtgtacgagttcttcctgagattcctggagagccccgacttccagcccaacatcgccaagaagtacatcgaccagaagttcgtgctgcagctgctggagctgttcgacagcgaggaccccagagagagagacttcctgaagaccaccctgcacagaatctacggcaagttcctgggcctgagagcctacatcagaaagcagatcaacaacatcttctacagattcatctacgagaccgagcaccacaacggcatcgccgagctgctggagatcctgggcagcatcatcaacggcttcgccctgcccctgaaggaggagcacaagatcttcctgctgaaggtgctgctgcccctgcacaaggtgaagagcctgagcgtgtaccacccccagctggcctactgcgtggtgcagttcctggagaaggacagcaccctgaccgagcccgtggtgatggccctgctgaagtactggcccaagacccacagccccaaggaggtgatgttcctgaacgagctggaggagatcctggacgtgatcgagcccagcgagttcgtgaagatcatggagcccctgttcagacagctggccaagtgcgtgagcagcccccacttccaggtggccgagagagccctgtactactggaacaacgagtacatcatgagcctgatcagcgacaacgccgccaagatcctgcccatcatgttccccagcctgtacagaaacagcaagacccactggaacaagaccatccacggcctgatctacaacgccctgaagctgttcatggagatgaaccagaagctgttcgacgactgcacccagcagttcaaggccgagaagctgaaggagaagctgaagatgaaggagagagaggaggcctgggtgaagatcgagaacctggccaaggccaacccccagtacaccgtgtacagccaggccagcaccatgagcatccccgtggccatggagaccgacggccccctgttcgaggacgtgcagatgctgagaaagaccgtgaaggacgaggcccaccaggcccagaaggaccccaagaaggacagacccctggccagaagaaagagcgagctgccccaggacccccacaccaagaaggccctggaggcccactgcagagccgacgagctggccagccaggacggcagatag

SEQ ID NO: 95383 - DNA, 1077 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggcctacgccgactacatcggcttcatcctgaccctgaacgagggcgtgaagggcaagaagctgaccttcgagtacagagtgagcgagatgtggaacgaggtgcacgaggagaaggagcaggccgccaagcagagcgtgagctgcgacgagtgcatccccctgcccagagccggccactgcgcccccagcgaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtgcctggagaagttccccgtgatccagcacttcaagttcggcagcctgctgcccatccaccccgtgaccagcggctag

SEQ ID NO: 95384 - DNA, 990 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggtgcccttcggcaccgtggcctacgccgactacatcggcttcatcctgaccctgaacgagggcgtgaagggcaagaagctgaccttcgagtacagagtgagcgaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtgcctggagaagttccccgtgatccagcacttcaagttcggcagcctgctgcccatccaccccgtgaccagcggctag

SEQ ID NO: 95385 - DNA, 846 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggcctacgccgactacatcggcttcatcctgaccctgaacgagggcgtgaagggcaagaagctgaccttcgagtacagagtgagcgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtgcctggagaagttccccgtgatccagcacttcaagttcggcagcctgctgcccatccaccccgtgaccagcggctag

SEQ ID NO: 95386 - DNA, 885 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtgcctggagaagttccccgtgatccagcacttcaagttcggcagcctgctgcccatccaccccgtgaccagcggctag

SEQ ID NO: 95387 - DNA, 972 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggcctacgccgactacatcggcttcatcctgaccctgaacgagggcgtgaagggcaagaagctgaccttcgagtacagagtgagcgaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtgcctggagaagttccccgtgatccagcacttcaagttcggcagcctgctgcccatccaccccgtgaccagcggctag

SEQ ID NO: 95388 - DNA, 972 bp, Artificial Sequence; identical to SEQ ID NO: 95387
  Description of Artificial Sequence: Synthetic coding sequence

SEQ ID NO: 95389 - DNA, 792 bp, Artificial Sequence
  Description of Artificial Sequence: Synthetic coding sequence
atgggcaagtggaagagaagccaggcctacgccgactacatcggcttcatcctgaccctgaacgagggcgtgaagggcaagaagctgaccttcgagtacagagtgagcgaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgagtag

SEQ ID NO: 95390 - DNA, 1125 bp, Artificial Sequence
  Description of Artificial Sequence: Synthetic coding sequence
atggccgagggcgagagacagcccccccccgacagcagcgaggaggccccccccgccacccagaacttcatcatccccaagaaggagatccacaccgtgcccgacatgggcaagtggaagagaagccaggcctacgccgactacatcggcttcatcctgaccctgaacgagggcgtgaagggcaagaagctgaccttcgagtacagagtgagcgagatgtggaacgaggtgcacgaggagaaggagcaggccgccaagcagagcgtgagctgcgacgagtgcatccccctgcccagagccggccactgcgcccccagcgaggccatcgagaagctggtggccctgctgaacaccctggacagatggatcgacgagaccccccccgtggaccagcccagcagattcggcaacaaggcctacagaacctggtacgccaagctggacgaggaggccgagaacctggtggccaccgtggtgcccacccacctggccgccgccgtgcccgaggtggccgtgtacctgaaggagagcgtgggcaacagcaccagaatcgactacggcaccggccacgaggccgccttcgccgccttcctgtgctgcctgtgcaagatcggcgtgctgagagtggacgaccagatcgccatcgtgttcaaggtgttcaacagatacctggaggtgatgagaaagctgcagaagacctacagaatggagcccgccggcagccagggcgtgtggggcctggacgacttccagttcctgcccttcatctggggcagcagccagctgatcgaccacccctacctggagcccagacacttcgtggacgagaaggccgtgaacgagaaccacaaggactacatgttcctggagtgcatcctgttcatcaccgagatgaagaccggccccttcgccgagcacagcaaccagctgtggaacatcagcgccgtgcccagctggagcaaggtgaaccagggcctgatcagaatgtacaaggccgaggccagccccagcgacacctggggcctgggcatcagccacctgggccacggccagagcgagaagcaccagcccccccagcccagaaaggccgccgtgcagctgtgccccgacgagctgggcggctag

SEQ ID NO: 95391 - DNA, 456 bp, Artificial Sequence
  Description of Artificial Sequence: Synthetic coding sequence
atgaagaccggccccttcgccgagcacagcaaccagctgtggaacatcagcgccgtgcccagctggagcaaggtgaaccagggcctgatcagaatgtacaaggccgaggtgagcggcggctggcccgtgtgccccagcctgctgccccacctggtgctgggctggggccagagcaagagatgcggcacctggggcagctgcttcctgctgccccactgcttcgccctgaacctgagacccgcccccctgaccctgggcgccagcgagagccccatctggggcatgggcagccagagaagcaccagccaccccagccccgagaagctgcagagcagcagcgtgctgatgagcctggaggccgaggccagaacctgctgcatgggcagcggcggcgacggcggcctgcccagccccctgagcagcggccagagactgctgaaggccagagccgtgtag

SEQ ID NO: 95392 - DNA, 2802 bp, Artificial Sequence
  Description of Artificial Sequence: Synthetic coding sequence
atggccgacctgagcctgctgcaggaggacctgcaggaggacgccgacggcagcctggacttcgtgagccaggacgagatgctgacccccctgggcagactggacaagtacgccgccagcgagaacatcttcaacagacagatggtggccagaagcctgctggacaccctgagagaggtgtgcgacgacgagagagactgcatcgccgtgctggagagaatcagcagactggccgacgacagcgagcccaccgtgagagccgagctgatggagcaggtgccccacatcgccctgttctgccaggagaacagacccagcatcccctacgccttcagcaagttcctgctgcccatcgtggtgagatacctggccgaccagaacaaccaggtgagaaagaccagccaggccgccctgctggccctgctggagcaggagctgatcgagagattcgacgtggagaccaaggtgtgccccgtgctgatcgagctgaccgcccccgacagcaacgacgacgtgaagaccgaggccgtggccatcatgtgcaagatggcccccatggtgggcaaggacatcaccgagagactgatcctgcccagattctgcgagatgtgctgcgactgcagaatgttccacgtgagaaaggtgtgcgccgccaacttcggcgacatctgcagcgtggtgggccagcaggccaccgaggagatgctgctgcccagattcttccagctgtgcagcgacaacgtgtggggcgtgagaaaggcctgcgccgagtgcttcatggccgtgagctgcgccacctgccaggagatcagaagaaccaagctgagcgccctgttcatcaacctgatcagcgaccccagcagatgggtgagacaggccgccttccagagcctgggccccttcatcagcaccttcgccaaccccagcagcagcggccagtacttcaaggaggagagcaagagcagcgaggagatgagcgtggagaacaagaacagaaccagagaccaggaggcccccgaggacgtgcaggtgagacccgaggacacccccagcgacctgagcgtgagcaacagcagcgtgatcctggagaacaccatggaggaccacgccgccgaggccagcggcaagcccctgggcgagatcagcgtgcccctggacagcagcctgctgtgcaccctgagcagcgagagccaccaggaggccgccagcaacgagaacgacaagaagcccggcaactacaagagcatgctgagacccgaggtgggcaccaccagccaggacagcgccctgctggaccaggagctgtacaacagcttccacttctggagaacccccctgcccgagatcgacctggacatcgagctggagcagaacagcggcggcaagcccagccccgagggccccgaggaggagagcgagggccccgtgcccagcagccccaacatcaccatggccaccagaaaggagctggaggagatgatcgagaacctggagccccacatcgacgaccccgacgtgaaggcccaggtggaggtgctgagcgccgccctgagagccagcagcctggacgcccacgaggagaccatcagcatcgagaagagaagcgacctgcaggacgagctggacatcaacgagctgcccaactgcaagatcaaccaggaggacagcgtgcccctgatcagcgacgccgtggagaacatggacagcaccctgcactacatccacagcgacagcgacctgagcaacaacagcagcttcagccccgacgaggagagaagaaccaaggtgcaggacgtggtgccccaggccctgctggaccagtacctgagcatgaccgaccccagcagagcccagaccgtggacaccgagatcgccaagcactgcgcctacagcctgcccggcgtggccctgaccctgggcagacagaactggcactgcctgagagagacctacgagaccctggccagcgacatgcagtggaaggtgagaagaaccctggccttcagcatccacgagctggccgtgatcctgggcgaccagctgaccgccgccgacctggtgcccatcttcaacggcttcctgaaggacctggacgaggtgagaatcggcgtgctgaagcacctgcacgacttcctgaagctgctgcacatcgacaagagaagagagtacctgtaccagctgcaggagttcctggtgaccgacaacagcagaaactggagattcagagccgagctggccgagcagctgatcctgctgctggagctgtacagccccagagacgtgtacgactacctgagacccatcgccctgaacctgtgcgccgacaaggtgagcagcgtgagatggatcagctacaagctggtgagcgagatggtgaagaagctgcacgccgccaccccccccaccttcggcgtggacctgatcaacgagctggtggagaacttcggcagatgccccaagtggagcggcagacaggccttcgtgttcgtgtgccagaccgtgatcgaggacgactgcctgcccatggaccagttcgccgtgcacctgatgccccacctgctgaccctggccaacgacagagtgcccaacgtgagagtgctgctggccaagaccctgagacagaccctgctggagaaggactacttcctggccagcgccagctgccaccaggaggccgtggagcagaccatcatggccctgcagatggacagagacagcgacgtgaagtacttcgccagcatccaccccgccagcaccaagatcagcgaggacgccatgagcaccgccagcagcacctactag

SEQ ID NO: 95393 - DNA, 924 bp, Artificial Sequence
  Description of Artificial Sequence: Synthetic coding sequence
atggccgagatcagcgacctggacagacagatcgagcagctgagaagatgcgagctgatcaaggagagcgaggtgaaggccctgtgcgccaaggccagagagatcctggtggaggagagcaacgtgcagagagtggacagccccgtgaccgtgtgcggcgacatccacggccagttctacgacctgaaggagctgttcagagtgggcggcgacgtgcccgagaccaactacctgttcatgggcgacttcgtggacagaggcttctacagcgtggagaccttcctgctgctgctggccctgaaggtgagataccccgacagaatcaccctgatcagaggcaaccacgagagcagacagatcacccaggtgtacggcttctacgacgagtgcctgagaaagtacggcagcgtgaccgtgtggagatactgcaccgagatcttcgactacctgagcctgagcgccatcatcgacggcaagatcttctgcgtgcacggcggcctgagccccagcatccagaccctggaccagatcagaaccatcgacagaaagcaggaggtgccccacgacggccccatgtgcgacctgctgtggagcgaccccgaggacaccaccggctggggcgtgagccccagaggcgccggctacctgttcggcagcgacgtggtggcccagttcaacgccgccaacgacatcgacatgatctgcagagcccaccagctggtgatggagggctacaagtggcacttcaacgagaccgtgctgaccgtgtggagcgcccccaactactgctacagatgcggcaacgtggccgccatcctggagctggacgagcacctgcagaaggacttcatcatcttcgaggccgccccccaggagaccagaggcatccccagcaagaagcccgtggccgactacttcctgtag

SEQ ID NO: 95394 - DNA, 1413 bp, Artificial Sequence
  Description of Artificial Sequence: Synthetic coding sequence
atgctgcaggtgagaacctacctgaccgagcccaccgtgagagccgagctgatggagcaggtgccccacatcgccctgttctgccaggagaacagacccagcatcccctacgccttcagcaagttcctgctgcccatcgtggtgagatacctggccgaccagaacaaccaggtgagaaagaccagccaggccgccctgctggccctgctggagcaggagctgatcgagagattcgacgtggagaccaaggtgtgccccgtgctgatcgagctgaccgcccccgacagcaacgacgacgtgaagaccgaggccgtggccatcatgtgcaagatggcccccatggtgggcaaggacatcaccgagagactgatcctgcccagattctgcgagatgtgctgcgactgcagaatgttccacgtgagaaaggtgtgcgccgccaacttcggcgacatctgcagcgtggtgggccagcaggccaccgaggagatgctgctgcccagattcttccagctgtgcagcgacaacgtgtggggcgtgagaaaggcctgcgccgagtgcttcatggccgtgagctgcgccacctgccaggagatcagaagaaccaagctgagcgccctgttcatcaacctgatcagcgaccccagcagatgggtgagacaggccgccttccagagcctgggccccttcatcagcaccttcgccaaccccagcagcagcggccagtacttcaaggaggagagcaagagcagcgaggagatgagcgtggagaacaagaacagaaccagagaccaggaggcccccgaggacgtgcaggtgagacccgaggacacccccagcgacctgagcgtgagcaacagcagcgtgatcctggagaacaccatggaggaccacgccgccgaggccagcggcaagcccctgggcgagatcagcgtgcccctggacagcagcctgctgtgcaccctgagcagcgagagccaccaggaggccgccagcaacgagaacgacaagaagcccggcaactacaagagcatgctgagacccgaggtgggcaccaccagccaggacagcgccctgctggaccaggagctgtacaacagcttccacttctggagaacccccctgcccgagatcgacctggacatcgagctggagcagaacagcggcggcaagcccagccccgagggccccgaggaggagagcgagggccccgtgcccagcagccccaacatcaccatggccaccagaaaggagctggaggagatgatcgagaacctggagccccacatcgacgaccccgacgtgaaggcccaggtggaggtgctgagcgccgccctgagagccagcagcctggacgcccacgaggagaccatcagcatcaagagagaggtgatctgcaagatgaactggatctag

SEQ ID NO: 95395 - DNA, 2853 bp, Artificial Sequence
  Description of Artificial Sequence: Synthetic coding sequence
atggccgacctgagcctgctgcaggaggacctgcaggaggacgccgacggcttcggcgtggacgactacagcagcgagagcgacgtgatcatcatccccagcgccctggacttcgtgagccaggacgagatgctgacccccctgggcagactggacaagtacgccgccagcgagaacatcttcaacagacagatggtggccagaagcctgctggacaccctgagagaggtgtgcgacgacgagagagactgcatcgccgtgctggagagaatcagcagactggccgacgacagcgagcccaccgtgagagccgagctgatggagcaggtgccccacatcgccctgttctgccaggagaacagacccagcatcccctacgccttcagcaagttcctgctgcccatcgtggtgagatacctggccgaccagaacaaccaggtgagaaagaccagccaggccgccctgctggccctgctggagcaggagctgatcgagagattcgacgtggagaccaaggtgtgccccgtgctgatcgagctgaccgcccccgacagcaacgacgacgtgaagaccgaggccgtggccatcatgtgcaagatggcccccatggtgggcaaggacatcaccgagagactgatcctgcccagattctgcgagatgtgctgcgactgcagaatgttccacgtgagaaaggtgtgcgccgccaacttcggcgacatctgcagcgtggtgggccagcaggccaccgaggagatgctgctgcccagattcttccagctgtgcagcgacaacgtgtggggcgtgagaaaggcctgcgccgagtgcttcatggccgtgagctgcgccacctgccaggagatcagaagaaccaagctgagcgccctgttcatcaacctgatcagcgaccccagcagatgggtgagacaggccgccttccagagcctgggccccttcatcagcaccttcgccaaccccagcagcagcggccagtacttcaaggaggagagcaagagcagcgaggagatgagcgtggagaacaagaacagaaccagagaccaggaggcccccgaggacgtgcaggtgagacccgaggacacccccagcgacctgagcgtgagcaacagcagcgtgatcctggagaacaccatggaggaccacgccgccgaggccagcggcaagcccctgggcgagatcagcgtgcccctggacagcagcctgctgtgcaccctgagcagcgagagccaccaggaggccgccagcaacgagaacgacaagaagcccggcaactacaagagcatgctgagacccgaggtgggcaccaccagccaggacagcgccctgctggaccaggagctgtacaacagcttccacttctggagaacccccctgcccgagatcgacctggacatcgagctggagcagaacagcggcggcaagcccagccccgagggccccgaggaggagagcgagggccccgtgcccagcagccccaacatcaccatggccaccagaaaggagctggaggagatgatcgagaacctggagccccacatcgacgaccccgacgtgaaggcccaggtggaggtgctgagcgccgccctgagagccagcagcctggacgcccacgaggagaccatcagcatcgagaagagaagcgacctgcaggacgagctggacatcaacgagctgcccaactgcaagatcaaccaggaggacagcgtgcccctgatcagcgacgccgtggagaacatggacagcaccctgcactacatccacagcgacagcgacctgagcaacaacagcagcttcagccccgacgaggagagaagaaccaaggtgcaggacgtggtgccccaggccctgctggaccagtacctgagcatgaccgaccccagcagagcccagaccgtggacaccgagatcgccaagcactgcgcctacagcctgcccggcgtggccctgaccctgggcagacagaactggcactgcctgagagagacctacgagaccctggccagcgacatgcagtggaaggtgagaagaaccctggccttcagcatccacgagctggccgtgatcctgggcgaccagctgaccgccgccgacctggtgcccatcttcaacggcttcctgaaggacctggacgaggtgagaatcggcgtgctgaagcacctgcacgacttcctgaagctgctgcacatcgacaagagaagagagtacctgtaccagctgcaggagttcctggtgaccgacaacagcagaaactggagattcagagccgagctggccgagcagctgatcctgctgctggagctgtacagccccagagacgtgtacgactacctgagacccatcgccctgaacctgtgcgccgacaaggtgagcagcgtgagatggatcagctacaagctggtgagcgagatggtgaagaagctgcacgccgccaccccccccaccttcggcgtggacctgatcaacgagctggtggagaacttcggcagatgccccaagtggagcggcagacaggccttcgtgttcgtgtgccagaccgtgatcgaggacgactgcctgcccatggaccagttcgccgtgcacctgatgccccacctgctgaccctggccaacgacagagtgcccaacgtgagagtgctgctggccaagaccctgagacagaccctgctggagaaggactacttcctggccagcgccagctgccaccaggaggccgtggagcagaccatcatggccctgcagatggacagagacagcgacgtgaagtacttcgccagcatccaccccgccagcaccaagatcagcgaggacgccatgagcaccgccagcagcacctactag

SEQ ID NO: 95396 - DNA, 1086 bp, Artificial Sequence
  Description of Artificial Sequence: Synthetic coding sequence
atggacgacttcagaaccagcgcccccgagcccagaggcccccccaaccccaacgtggagtacatccccttcgacgagatgaaggagagaatcctgaagatcgtgaccggcttcaacggcatccccttcaccatccagagactgtgcgagctgctgaccgaccccagaagaaactacaccggcaccgacaagttcctgagaggcgtggagaagaacgtgatggtggtgagctgcgtgtaccccagcagcgagaagaacaacagcaacagcctgaacagaatgaacggcgtgatgttccccggcaacagccccagctacaccgagagaagcaacatcaacggccccggcacccccagacccctgaacagacccaaggtgagcctgagcgcccccatgaccaccaacggcctgcccgagagcaccgacagcaaggaggccaacctgcagcagaacgaggagaagaaccacagcgacagcagcaccagcgagagcgaggtgagcagcgtgagccccctgaagaacaagcaccccgacgaggacgccgtggaggccgagggccacgaggtgaagagactgagattcgacaaggagggcgaggtgagagagaccgccagccagaccaccagcagcgagatcagcagcgtgatggtgggcgagaccgaggccagcagcagcagccaggacaaggacaaggacagcagatgcaccagacagcactgcaccgaggaggacgaggaggaggacgaggaggaggaggaggagagcttcatgaccagcagagagatgatccccgagagaaagaaccaggagaaggagagcgacgacgccctgaccgtgaacgaggagaccagcgaggagaacaaccagatggaggagagcgacgtgagccaggccgagaaggacctgctgcacagcgagggcagcgagaacgagggccccgtgagcagcagcagcagcgactgcagagagaccgaggagctggtgggcagcaacagcagcaagaccggcgagatcctgagcgagagcagcatggagaacgacgacgaggccaccgaggtgaccgacgagcccatggagcaggactag

SEQ ID NO: 95397 - DNA, 1254 bp, Artificial Sequence
  Description of Artificial Sequence: Synthetic coding sequence
atggacgtggagagactgcaggaggccctgaaggacttcgagaagagaggcaagaaggaggtgtgccccgtgctggaccagttcctgtgccacgtggccaagaccggcgagaccatgatccagtggagccagttcaagggctacttcatcttcaagctggagaaggtgatggacgacttcagaaccagcgcccccgagcccagaggcccccccaaccccaacgtggagtacatccccttcgacgagatgaaggagagaatcctgaagatcgtgaccggcttcaacggcatccccttcaccatccagagactgtgcgagctgctgaccgaccccagaagaaactacaccggcaccgacaagttcctgagaggcgtggagaagaacgtgatggtggtgagctgcgtgtaccccagcagcgagaagaacaacagcaacagcctgaacagaatgaacggcgtgatgttccccggcaacagccccagctacaccgagagaagcaacatcaacggccccggcacccccagacccctgaacagacccaaggtgagcctgagcgcccccatgaccaccaacggcctgcccgagagcaccgacagcaaggaggccaacctgcagcagaacgaggagaagaaccacagcgacagcagcaccagcgagagcgaggtgagcagcgtgagccccctgaagaacaagcaccccgacgaggacgccgtggaggccgagggccacgaggtgaagagactgagattcgacaaggagggcgaggtgagagagaccgccagccagaccaccagcagcgagatcagcagcgtgatggtgggcgagaccgaggccagcagcagcagccaggacaaggacaaggacagcagatgcaccagacagcactgcaccgaggaggacgaggaggaggacgaggaggaggaggaggagagcttcatgaccagcagagagatgatccccgagagaaagaaccaggagaaggagagcgacgacgccctgaccgtgaacgaggagaccagcgaggagaacaaccagatggaggagagcgacgtgagccaggccgagaaggacctgctgcacagcgagggcagcgagaacgagggccccgtgagcagcagcagcagcgactgcagagagaccgaggagctggtgggcagcaacagcagcaagaccggcgagatcctgagcgagagcagcatggagaacgacgacgaggccaccgaggtgaccgacgagcccatggagcaggactag

SEQ ID NO: 95398 - DNA, 1083 bp, Artificial Sequence
  Description of Artificial Sequence: Synthetic coding sequence
atggacgtggagagactgcaggaggccctgaaggacttcgagaagagaggcaagaaggaggtgtgccccgtgctggaccagttcctgtgccacgtggccaagaccggcgagaccatcatccccttcaccatccagagactgtgcgagctgctgaccgaccccagaagaaactacaccggcaccgacaagttcctgagaggcgtggagaagaacgtgatggtggtgagctgcgtgtaccccagcagcgagaagaacaacagcaacagcctgaacagaatgaacggcgtgatgttccccggcaacagccccagctacaccgagagaagcaacatcaacggccccggcacccccagacccctgaacagacccaaggtgagcctgagcgcccccatgaccaccaacggcctgcccgagagcaccgacagcaaggaggccaacctgcagcagaacgaggagaagaaccacagcgacagcagcaccagcgagagcgaggtgagcagcgtgagccccctgaagaacaagcaccccgacgaggacgccgtggaggccgagggccacgaggtgaagagactgagattcgacaaggagggcgaggtgagagagaccgccagccagaccaccagcagcgagatcagcagcgtgatggtgggcgagaccgaggccagcagcagcagccaggacaaggacaaggacagcagatgcaccagacagcactgcaccgaggaggacgaggaggaggacgaggaggaggaggaggagagcttcatgaccagcagagagatgatccccgagagaaagaaccaggagaaggagagcgacgacgccctgaccgtgaacgaggagaccagcgaggagaacaaccagatggaggagagcgacgtgagccaggccgagaaggacctgctgcacagcgagggcagcgagaacgagggccccgtgagcagcagcagcagcgactgcagagagaccgaggagctggtgggcagcaacagcagcaagaccggcgagatcctgagcgagagcagcatggagaacgacgacgaggccaccgaggtgaccgacgagcccatggagcaggactag

SEQ ID NO: 95399 - DNA, 1116 bp, Artificial Sequence
  Description of Artificial Sequence: Synthetic coding sequence
atggccctgggcaagttcagagccgccctgagagactacgagaccgtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgaggacgagtacagcggccccaagctggaggacggcaaggtgaccatcagcttcatgaaggagctgatgcagtggtacaaggaccagaagaagctgcacagaaagtgcgcctaccagaccgagaagatcaccgtgtgcggcgacacccacggccagttctacgacctgctgaacatcttcgagctgaacggcctgcccagcgagaccaacccctacatcttcaacggcgacttcgtggacagaggcagcttcagcgtggaggtgatcctgaccctgttcggcttcaagctgctgtaccccgaccacttccacctgctgagaggcaaccacgagaccgacaacatgaaccagatctacggcttcgagggcgaggtgaaggccaagtacaccgcccagatgtacgagctgttcagcgaggtgttcgagtggctgcccctggcccagtgcatcaacggcaaggtgctgatcatgcacggcggcctgttcagcgaggacggcgtgaccctggacgacatcagaaagatcgagagaaacagacagccccccgacagcggccccatgtgcgacctgctgtggagcgacccccagccccagaacggcagaagcatcagcaagagaggcgtgagctgccagttcggccccgacgtgaccaaggccttcctggaggagaacaacctggactacatcatcagaagccacgaggtgaaggccgagggctacgaggtggcccacggcggcagatgcgtgaccgtgttcagcgcccccaactactgcgaccagatgggcaacaaggccagctacatccacctgcagggcagcgacctgagaccccagttccaccagttcaccgccgtgccccaccccaacgtgaagcccatggcctacgccaacaccctgctgcagctgggcatgatgtag

SEQ ID NO: 95400 - DNA, 1500 bp, Artificial Sequence
  Description of Artificial Sequence: Synthetic coding sequence
atggccatggccgagggcgagagaaccgagtgcgccgagccccccagagacgagccccccgccgacggcgccctgaagagagccgaggagctgaagacccaggccaacgactacttcaaggccaaggactacgagaacgccatcaagttctacagccaggccatcgagctgaaccccagcaacgccatctactacggcaacagaagcctggcctacctgagaaccgagtgctacggctacgccctgggcgacgccaccagagccatcgagctggacaagaagtacatcaagggctactacagaagagccgccagcaacatggccctgggcaagttcagagccgccctgagagactacgagaccgtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgaggacgagtacagcggccccaagctggaggacggcaaggtgaccatcagcttcatgaaggagctgatgcagtggtacaaggaccagaagaagctgcacagaaagtgcgcctaccagatcctggtgcaggtgaaggaggtgctgagcaagctgagcaccctggtggagaccaccctgaaggagaccgagaagatcaccgtgtgcggcgacacccacggccagttctacgacctgctgaacatcttcgagctgaacggcctgcccagcgagaccaacccctacatcttcaacggcgacttcgtggacagaggcagcttcagcgtggaggtgatcctgaccctgttcggcttcaagctgctgtaccccgaccacttccacctgctgagaggcaaccacgagaccgacaacatgaaccagatctacggcttcgagggcgaggtgaaggccaagtacaccgcccagatgtacgagctgttcagcgaggtgttcgagtggctgcccctggcccagtgcatcaacggcaaggtgctgatcatgcacggcggcctgttcagcgaggacggcgtgaccctggacgacatcagaaagatcgagagaaacagacagccccccgacagcggccccatgtgcgacctgctgtggagcgacccccagccccagaacggcagaagcatcagcaagagaggcgtgagctgccagttcggccccgacgtgaccaaggccttcctggaggagaacaacctggactacatcatcagaagccacgaggtgaaggccgagggctacgaggtggcccacggcggcagatgcgtgaccgtgttcagcgcccccaactactgcgaccagatgggcaacaaggccagctacatccacctgcagggcagcgacctgagaccccagttccaccagttcaccgccgtgccccaccccaacgtgaagcccatggcctacgccaacaccctgctgcagctgggcatgatgtag

SEQ ID NO: 95401 - DNA, 1461 bp, Artificial Sequence
  Description of Artificial Sequence: Synthetic coding sequence
atggccatggccgagggcgagagaaccgagtgcgccgagccccccagagacgagccccccgccgacggcgccctgaagagagccgaggagctgaagacccaggccaacgactacttcaaggccaaggactacgagaacgccatcaagttctacagccaggccatcgagctgaaccccagcaacgccatctactacggctacgccctgggcgacgccaccagagccatcgagctggacaagaagtacatcaagggctactacagaagagccgccagcaacatggccctgggcaagttcagagccgccctgagagactacgagaccgtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgaggacgagtacagcggccccaagctggaggacggcaaggtgaccatcagcttcatgaaggagctgatgcagtggtacaaggaccagaagaagctgcacagaaagtgcgcctaccagatcctggtgcaggtgaaggaggtgctgagcaagctgagcaccctggtggagaccaccctgaaggagaccgagaagatcaccgtgtgcggcgacacccacggccagttctacgacctgctgaacatcttcgagctgaacggcctgcccagcgagaccaacccctacatcttcaacggcgacttcgtggacagaggcagcttcagcgtggaggtgatcctgaccctgttcggcttcaagctgctgtaccccgaccacttccacctgctgagaggcaaccacgagaccgacaacatgaaccagatctacggcttcgagggcgaggtgaaggccaagtacaccgcccagatgtacgagctgttcagcgaggtgttcgagtggctgcccctggcccagtgcatcaacggcaaggtgctgatcatgcacggcggcctgttcagcgaggacggcgtgaccctggacgacatcagaaagatcgagagaaacagacagccccccgacagcggccccatgtgcgacctgctgtggagcgacccccagccccagaacggcagaagcatcagcaagagaggcgtgagctgccagttcggccccgacgtgaccaaggccttcctggaggagaacaacctggactacatcatcagaagccacgaggtgaaggccgagggctacgaggtggcccacggcggcagatgcgtgaccgtgttcagcgcccccaactactgcgaccagatgggcaacaaggccagctacatccacctgcagggcagcgacctgagaccccagttccaccagttcaccgccgtgccccaccccaacgtgaagcccatggcctacgccaacaccctgctgcagctgggcatgatgtag

SEQ ID NO: 95402 - DNA, 1458 bp, Artificial Sequence
  Description of Artificial Sequence: Synthetic coding sequence
tgaatggccgagggcgagagaaccgagtgcgccgagccccccagagacgagccccccgccgacggcgccctgaagagagccgaggagctgaagacccaggccaacgactacttcaaggccaaggactacgagaacgccatcaagttctacagccaggccatcgagctgaaccccagcaacgccatctactacggcaacagaagcctggcctacctgagaaccgagtgctacggctacgccctgggcgacgccaccagagccatcgagctggacaagaagtacatcaagggctactacagaagagccgccagcaacatggccctgggcaagttcagagccgccctgagagactacgagaccgtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgaggacgagtacagcggccccaagctggaggacggcaaggtgaccatcagcttcatgaaggagctgatgcagtggtacaaggaccagaagaagctgcacagaaagtgcgcctaccagatcctggtgcaggtgaaggaggtgctgagcaagctgagcaccctggtggagaccaccctgaaggagaccgagaagatcaccgtgtgcggcgacacccacggccagttctacgacctgctgaacatcttcgagctgaacggcctgcccagcgagaccaacccctacatcttcaacggcgacttcgtggacagaggcagcttcagcgtggaggtgatcctgaccctgttcggcttcaagctgctgtaccccgaccacttccacctgctgagaggcaaccacgagaccgacaacatgaaccagatctacggcttcgagggcgaggtgaaggccaagtacaccgcccagatgtacgagctgttcagcgaggtgttcgagtggctgcccctggcccagtgcatcaacggcaaggtgctgatcatgcacggcggcctgttcagcgaggacggcgtgaccctggacgacatcagaaagatcgagagaaacagacagccccccgacagcggccccatgtgcgacctgctgtggagcgacccccagccccagaacggcagaagcatcagcaagagaggcgtgagctgccagttcggccccgacgtgaccaaggccttcctggaggagaacaacctggactacatcatcagaagccacgaggtgaaggccgagggctacgaggtggcccacggcggcagatgcgtgaccgtgttcagcgcccccaactactgcgaccagatgggcaacaaggccagctacatccacctgcagggcagcgacctgagaccccagttccaccagttcaccgccgtgggcagacccagcagcggcagctag

SEQ ID NO: 95403 - DNA, 477 bp, Artificial Sequence
  Description of Artificial Sequence: Synthetic coding sequence
atgctgaccgtggccgccctgatcgacgagcagatcctgtgcgtgcacggcggcctgagccccgacatcaagaccctggaccagatcagaaccatcgagagaaaccaggagatcccccacaagggcgccttctgcgacctggtgtggagcgaccccgaggacgtggacacctgggccatcagccccagaggcgccggctggctgttcggcgccaaggtgaccaacgagttcgtgcacatcaacaacctgaagctgatctgcagagcccaccagctggtgcacgagggctacaagttcatgttcgacgagaagctggtgaccgtgtggagcgcccccaactactgctacagatgcggcaacatcgccagcatcatggtgttcaaggacgtgaacaccagagagcccaagctgttcagagccgtgcccgacagcgagagagtgatcccccccagaaccaccaccccctacttcctgtag

SEQ ID NO: 95404 - DNA, 918 bp, Artificial Sequence
  Description of Artificial Sequence: Synthetic coding sequence
atggcccccctggacctggacaagtacgtggagatcgccagactgtgcaagtacctgcccgagaacgacctgaagagactgtgcgactacgtgtgcgacctgctgctggaggagagcaacgtgcagcccgtgagcacccccgtgaccgtgtgcggcgacatccacggccagttctacgacctgtgcgagctgttcagaaccggcggccaggtgcccgacaccaactacatcttcatgggcgacttcgtggacagaggctactacagcctggagaccttcacctacctgctggccctgaaggccaagtggcccgacagaatcaccctgctgagaggcaaccacgagagcagacagatcacccaggtgtacggcttctacgacgagtgccagaccaagtacggcaacgccaacgcctggagatactgcaccaaggtgttcgacatgctgaccgtggccgccctgatcgacgagcagatcctgtgcgtgcacggcggcctgagccccgacatcaagaccctggaccagatcagaaccatcgagagaaaccaggagatcccccacaagggcgccttctgcgacctggtgtggagcgaccccgaggacgtggacacctgggccatcagccccagaggcgccggctggctgttcggcgccaaggtgaccaacgagttcgtgcacatcaacaacctgaagctgatctgcagagcccaccagctggtgcacgagggctacaagttcatgttcgacgagaagctggtgaccgtgtggagcgcccccaactactgctacagatgcggcaacatcgccagcatcatggtgttcaaggacgtgaacaccagagagcccaagctgttcagagccgtgcccgacagcgagagagtgatcccccccagaaccaccaccccctacttcctgtag

SEQ ID NO: 95405 - DNA, 852 bp, Artificial Sequence
  Description of Artificial Sequence: Synthetic coding sequence
atggcccccctggacctggacaagtacgtggagatcgccagactgtgcaagtacctgcccgagaacgacctgaagagactgtgcgactacgtgtgcgacctgctgctggaggagagcaacgtgcagcccgtgagcacccccgtgaccgtgtgcggcgacatccacggccagggcgacttcgtggacagaggctactacagcctggagaccttcacctacctgctggccctgaaggccaagtggcccgacagaatcaccctgctgagaggcaaccacgagagcagacagatcacccaggtgtacggcttctacgacgagtgccagaccaagtacggcaacgccaacgcctggagatactgcaccaaggtgttcgacatgctgaccgtggccgccctgatcgacgagcagatcctgtgcgtgcacggcggcctgagccccgacatcaagaccctggaccagatcagaaccatcgagagaaaccaggagatcccccacaagggcgccttctgcgacctggtgtggagcgaccccgaggacgtggacacctgggccatcagccccagaggcgccggctggctgttcggcgccaaggtgaccaacgagttcgtgcacatcaacaacctgaagctgatctgcagagcccaccagctggtgcacgagggctacaagttcatgttcgacgagaagctggtgaccgtgtggagcgcccccaactactgctacagatgcggcaacatcgccagcatcatggtgttcaaggacgtgaacaccagagagcccaagctgttcagagccgtgcccgacagcgagagagtgatcccccccagaaccaccaccccctacttcctgtag

SEQ ID NO: 95406 - DNA, 1029 bp, Artificial Sequence
  Description of Artificial Sequence: Synthetic coding sequence
atggcccccctggacctggacaagtacgtggagatcgccagactgtgcaagtacctgcccgagaacgacctgaaggtgagccccatctgcggcctggcccccagcggctgcggcgcccccgccggcagacccttcctgagccccggccccccccccgtgttccacttcctgagattcctgaaggagagactgtgcgactacgtgtgcgacctgctgctggaggagagcaacgtgcagcccgtgagcacccccgtgaccgtgtgcggcgacatccacggccagttctacgacctgtgcgagctgttcagaaccggcggccaggtgcccgacaccaactacatcttcatgggcgacttcgtggacagaggctactacagcctggagaccttcacctacctgctggccctgaaggccaagtggcccgacagaatcaccctgctgagaggcaaccacgagagcagacagatcacccaggtgtacggcttctacgacgagtgccagaccaagtacggcaacgccaacgcctggagatactgcaccaaggtgttcgacatgctgaccgtggccgccctgatcgacgagcagatcctgtgcgtgcacggcggcctgagccccgacatcaagaccctggaccagatcagaaccatcgagagaaaccaggagatcccccacaagggcgccttctgcgacctggtgtggagcgaccccgaggacgtggacacctgggccatcagccccagaggcgccggctggctgttcggcgccaaggtgaccaacgagttcgtgcacatcaacaacctgaagctgatctgcagagcccaccagctggtgcacgagggctacaagttcatgttcgacgagaagctggtgaccgtgtggagcgcccccaactactgctacagatgcggcaacatcgccagcatcatggtgttcaaggacgtgaacaccagagagcccaagctgttcagagccgtgcccgacagcgagagagtgatcccccccagaaccaccaccccctacttcctgtag

SEQ ID NO: 95407 - DNA, 378 bp, Artificial Sequence
  Description of Artificial Sequence: Synthetic coding sequence
atgttcctgctgcccagactgcagctgctgggccagatgagactgtgcgactacgtgtgcgacctgctgctggaggagagcaacgtgcagcccgtgagcacccccgtgaccgtgtgcggcgacatccacggccagttctacgacctgtgcgagctgttcagaaccggcggccaggtgcccgacaccaactacatcttcatgggcgacttcgtggacagaggctactacagcctggagaccttcacctacctgctggccctgaaggccaagtggcccgacagaatcaccctgctgagaggcaaccacgagagcagacagatcacccaggtgtacggcttctacgacgagtgccagaccaagtacggcaacgccaactag

SEQ ID NO: 95408 - DNA, 1161 bp, Artificial Sequence
  Description of Artificial Sequence: Synthetic coding sequence
atgagcgccctggagaagagcatgcacctgggcagactgcccagcagaccccccctgcccggcagcggcggcagccagagcggcgccaagatgagaatgggccccggcagaaagagagacttcagccccgtgccctggagccagtacttcgagagcatggaggacgtggaggtggagaacgagaccggcaaggacaccttcagagtgtacaagagcggcagcgagggccccgtgctgctgctgctgcacggcggcggccacagcgccctgagctgggccgtgttcaccgccgccatcatcagcagagtgcagtgcagaatcgtggccctggacctgagaagccacggcgagaccaaggtgaagaaccccgaggacctgagcgccgagaccatggccaaggacgtgggcaacgtggtggaggccatgtacggcgacctgcccccccccatcatgctgatcggccacagcatgggcggcgccatcgccgtgcacaccgccagcagcaacctggtgcccagcctgctgggcctgtgcatgatcgacgtggtggagggcaccgccatggacgccctgaacagcatgcagaacttcctgagaggcagacccaagaccttcaagagcctggagaacgccatcgagtggagcgtgaagagcggccagatcagaaacctggagagcgccagagtgagcatggtgggccaggtgaagcagtgcgagggcatcaccagccccgagggcagcaagagcatcgtggagggcatcatcgaggaggaggaggaggacgaggagggcagcgagagcatcagcaagagaaagaaggaggacgacatggagaccaagaaggaccacccctacacctggagaatcgagctggccaagaccgagaagtactgggacggctggttcagaggcctgagcaacctgttcctgagctgccccatccccaagctgctgctgctggccggcgtggacagactggacaaggacctgaccatcggccagatgcagggcaagttccagatgcaggtgctgccccagtgcggccacgccgtgcacgaggacgcccccgacaaggtggccgaggccgtggccaccttcctgatcagacacagattcgccgagcccatcggcggcttccagtgcgtgttccccggctgctag

SEQ ID NO: 95409 - DNA, 600 bp, Artificial Sequence
  Description of Artificial Sequence: Synthetic coding sequence
atggacgccctgaacagcatgcagaacttcctgagaggcagacccaagaccttcaagagcctggagaacgccatcgagtggagcgtgaagagcggccagatcagaaacctggagagcgccagagtgagcatggtgggccaggtgaagcagtgcgagggcatcaccagccccgagggcagcaagagcatcgtggagggcatcatcgaggaggaggaggaggacgaggagggcagcgagagcatcagcaagagaaagaaggaggacgacatggagaccaagaaggaccacccctacacctggagaatcgagctggccaagaccgagaagtactgggacggctggttcagaggcctgagcaacctgttcctgagctgccccatccccaagctgctgctgctggccggcgtggacagactggacaaggacctgaccatcggccagatgcagggcaagttccagatgcaggtgctgccccagtgcggccacgccgtgcacgaggacgcccccgacaaggtggccgaggccgtggccaccttcctgatcagacacagattcgccgagcccatcggcggcttccagtgcgtgttccccggctgctag

SEQ ID NO: 95410 - DNA, 1203 bp, Artificial Sequence
  Description of Artificial Sequence: Synthetic coding sequence
atgagcgccctggagaagagcatgcacctgggcagactgcccagcagaccccccctgcccggcagcggcggcagccagagcggcgccaagatgagaatgggccccggcagaaagagagacttcagccccgtgccctggagccagtacttcgagagcatggaggacgtggaggtggagaacgagaccggcaaggacaccttcagagtgtacaagagcggcagcgagggccccgtgctgctgctgctgcacggcggcggccacagcgccctgagctgggccgtgttcaccgccgccatcatcagcagagtgcagtgcagaatcgtggccctggacctgagaagccacggcgagaccaaggtgaagaaccccgaggacctgagcgccgagaccatggccaaggacgtgggcaacgtggtggaggccatgtacggcgacctgcccccccccatcatgctgatcggccacagcatgggcggcgccatcgccgtgcacaccgccagcagcaacctggtgcccagcctgctgggcctgtgcatgatcgacgtggtggagggcaccgccatggacgccctgaacagcatgcagaacttcctgagaggcagacccaagaccttcaagagcctggagaacgccatcgagtggagcgtgaagagcggccagatcagaaacctggagagcgccagagtgagcatggtgggccaggtgaagcagtgcgagggcatcaccagccccgagggcagcaagagcatcgtggagggcatcatcgaggaggaggaggaggacgaggagggcagcgagagcatcagcaagagaaagaaggaggacgacatggagggcctgcccagcgagacccagaacctgctgctgttcctgcagaccaagaaggaccacccctacacctggagaatcgagctggccaagaccgagaagtactgggacggctggttcagaggcctgagcaacctgttcctgagctgccccatccccaagctgctgctgctggccggcgtggacagactggacaaggacctgaccatcggccagatgcagggcaagttccagatgcaggtgctgccccagtgcggccacgccgtgcacgaggacgcccccgacaaggtggccgaggccgtggccaccttcctgatcagacacagattcgccgagcccatcggcggcttccagtgcgtgttccccggctgctag

SEQ ID NO: 95411 - DNA, 1776 bp, Artificial Sequence
  Description of Artificial Sequence: Synthetic coding sequence
atgggctgcagcagcagcagcaccaagaccagaagaagcgacaccagcctgagagccgccctgatcatccagaactggtacagaggctacaaggccagactgaaggccagacagcactacgccctgaccatcttccagagcatcgagtacgccgacgagcagggccagatgcagctgagcaccttcttcagcttcatgctggagaactacacccacatccacaaggaggagctggagctgagaaaccagagcctggagagcgagcaggacatgagagacagatgggactacgtggacagcatcgacgtgcccgacagctacaacggccccagactgcagttccccctgacctgcaccgacatcgacctgctgctggaggccttcaaggagcagcagatcctgcacgcccactacgtgctggaggtgctgttcgagaccaagaaggtgctgaagcagatgcccaacttcacccacatccagaccagccccagcaaggaggtgaccatctgcggcgacctgcacggcaagctggacgacctgttcctgatcttctacaagaacggcctgcccagcgagagaaacccctacgtgttcaacggcgacttcgtggacagaggcaagaacagcatcgagatcctgatgatcctgtgcgtgagcttcctggtgtaccccaacgacctgcacctgaacagaggcaaccacgaggacttcatgatgaacctgagatacggcttcaccaaggagatcctgcacaagtacaagctgcacggcaagagaatcctgcagatcctggaggagttctacgcctggctgcccatcggcaccatcgtggacaacgagatcctggtgatccacggcggcatcagcgagaccaccgacctgaacctgctgcacagagtggagagaaacaagatgaagagcgtgctgatcccccccaccgagaccaacagagaccacgacaccgacagcaagcacaacaaggtgggcgtgaccttcaacgcccacggcagaatcaagaccaacggcagccccaccgagcacctgaccgagcacgagtgggagcaggtggtgaccatcttcagcgccagcaactactacgaggagggcagcaacagaggcgcctacatcaagctgtgcagcggcaccacccccagattcttccagtaccaggtgaccaaggccacctgcttccagcccctgagacagagagtggacaccatggagaacagcgccatcaagatcctgagagagagagtgatcagcagaaagagcgacctgaccagagccttccagctgcaggaccacagaaagagcggcaagctgagcgtgagccagtgggccttctgcatggagaacatcctgggcctgaacctgccctggagaagcctgagcagcaacctggtgaacatcgaccagaacggcaacgtggagtacatgagcagcttccagaacatcagaatcgagaagcccgtgcaggaggcccacagcaccctggtggagaccctgtacagatacagaagcgacctggagatcatcttcaacgccatcgacaccgaccacagcggcctgatcagcgtggaggagttcagagccatgtggaagctgttcagcagccactacaacgtgcacatcgacgacagccaggtgaacaagctggccaacatcatggacctgaacaaggacggcagcatcgacttcaacgagttcctgaaggccttctacgtggtgcacagatacgaggacctgatgaagcccgacgtgaccaacctgggctag

SEQ ID NO: 95412 - DNA, 1803 bp, Artificial Sequence
  Description of Artificial Sequence: Synthetic coding sequence
atgggctgcagcagcagcagcaccaagaccagaagaagcgacaccagcctgagagccgccctgatcatccagaactggtacagaggctacaaggccagactgaaggccagacagcactacgccctgaccatcttccagagcatcgagtacgccgacgagcagggccagatgcagctgagcaccttcttcagcttcatgctggagaactacacccacatccacaaggaggagctggagatcctgcacgcccactacgtgctggaggtgctgttcgagaccaagaaggtgctgaagcagatgcccaacttcacccacatccagaccagccccagcaaggaggtgaccatctgcggcgacctgcacggcaagctggacgacctgttcctgatcttctacaagaacggcctgcccagcgagagaaacccctacgtgttcaacggcgacttcgtggacagaggcaagaacagcatcgagatcctgatgatcctgtgcgtgagcttcctggtgtaccccaacgacctgcacctgaacagaggcaaccacgaggacttcatgatgaacctgagatacggcttcaccaaggagatcctgcacaagtacaagctgcacggcaagagaatcctgcagatcctggaggagttctacgcctggctgcccatcggcaccatcgtggacaacgagatcctggtgatccacggcggcatcagcgagaccaccgacctgaacctgctgcacagagtggagagaaacaagatgaagagcgtgctgatcccccccaccgagaccaacagagaccacgacaccgacagcaagcacaacaaggtgggcgtgaccttcaacgcccacggcagaatcaagaccaacggcagccccaccgagcacctgaccgagcacgagtgggagcagatcatcgacatcctgtggagcgaccccagaggcaagaacggctgcttccccaacacctgcagaggcggcggctgctacttcggccccgacgtgaccagcaagatcctgaacaagtaccagctgaagatgctgatcagaagccacgagtgcaagcccgagggctacgagatctgccacgacggcaaggtggtgaccatcttcagcgccagcaactactacgaggagggcagcaacagaggcgcctacatcaagctgtgcagcggcaccacccccagattcttccagtaccaggtgaccaaggccacctgcttccagcccctgagacagagagtggacaccatggagaacagcgccatcaagatcctgagagagagagtgatcagcagaaagagcgacctgaccagagccttccagctgcaggaccacagaaagagcggcaagctgagcgtgagccagtgggccttctgcatggagaacatcctgggcctgaacctgccctggagaagcctgagcagcaacctggtgaacatcgaccagaacggcaacgtggagtacatgagcagcttccagaacatcagaatcgagaagcccgtgcaggaggcccacagcaccctggtggagaccctgtacagatacagaagcgacctggagatcatcttcaacgccatcgacaccgaccacagcggcctgatcagcgtggaggagttcagagccatgtggaagctgttcagcagccactacaacgtgcacatcgacgacagccaggtgaacaagctggccaacatcatggacctgaacaaggacggcagcatcgacttcaacgagttcctgaaggccttctacgtggtgcacagatacgaggacctgatgaagcccgacgtgaccaacctgggctag

SEQ ID NO: 95413 - DNA, 1962 bp, Artificial Sequence
  Description of Artificial Sequence: Synthetic coding sequence
atgggctgcagcagcagcagcaccaagaccagaagaagcgacaccagcctgagagccgccctgatcatccagaactggtacagaggctacaaggccagactgaaggccagacagcactacgccctgaccatcttccagagcatcgagtacgccgacgagcagggccagatgcagctgagcaccttcttcagcttcatgctggagaactacacccacatccacaaggaggagctggagctgagaaaccagagcctggagagcgagcaggacatgagagacagatgggactacgtggacagcatcgacgtgcccgacagctacaacggccccagactgcagttccccctgacctgcaccgacatcgacctgctgctggaggccttcaaggagcagcagatcctgcacgcccactacgtgctggaggtgctgttcgagaccaagaaggtgctgaagcagatgcccaacttcacccacatccagaccagccccagcaaggaggtgaccatctgcggcgacctgcacggcaagctggacgacctgttcctgatcttctacaagaacggcctgcccagcgagagaaacccctacgtgttcaacggcgacttcgtggacagaggcaagaacagcatcgagatcctgatgatcctgtgcgtgagcttcctggtgtaccccaacgacctgcacctgaacagaggcaaccacgaggacttcatgatgaacctgagatacggcttcaccaaggagatcctgcacaagtacaagctgcacggcaagagaatcctgcagatcctggaggagttctacgcctggctgcccatcggcaccatcgtggacaacgagatcctggtgatccacggcggcatcagcgagaccaccgacctgaacctgctgcacagagtggagagaaacaagatgaagagcgtgctgatcccccccaccgagaccaacagagaccacgacaccgacagcaagcacaacaaggtgggcgtgaccttcaacgcccacggcagaatcaagaccaacggcagccccaccgagcacctgaccgagcacgagtgggagcagatcatcgacatcctgtggagcgaccccagaggcaagaacggctgcttccccaacacctgcagaggcggcggctgctacttcggccccgacgtgaccagcaagatcctgaacaagtaccagctgaagatgctgatcagaagccacgagtgcaagcccgagggctacgagatctgccacgacggcaaggtggtgaccatcttcagcgccagcaactactacgaggagggcagcaacagaggcgcctacatcaagctgtgcagcggcaccacccccagattcttccagtaccaggtgaccaaggccacctgcttccagcccctgagacagagagtggacaccatggagaacagcgccatcaagatcctgagagagagagtgatcagcagaaagagcgacctgaccagagccttccagctgcaggaccacagaaagagcggcaagctgagcgtgagccagtgggccttctgcatggagaacatcctgggcctgaacctgccctggagaagcctgagcagcaacctggtgaacatcgaccagaacggcaacgtggagtacatgagcagcttccagaacatcagaatcgagaagcccgtgcaggaggcccacagcaccctggtggagaccctgtacagatacagaagcgacctggagatcatcttcaacgccatcgacaccgaccacagcggcctgatcagcgtggaggagttcagagccatgtggaagctgttcagcagccactacaacgtgcacatcgacgacagccaggtgaacaagctggccaacatcatggacctgaacaaggacggcagcatcgacttcaacgagttcctgaaggccttctacgtggtgcacagatacgaggacctgatgaagcccgacgtgaccaacctgggctag

SEQ ID NO: 95414 - DNA, 1131 bp, Artificial Sequence
  Description of Artificial Sequence: Synthetic coding sequence
atgggctgcagcagcagcagcaccaagaccagaagaagcgacaccagcctgagagccgccctgatcatccagaactggtacagaggctacaaggccagactgaaggccagacagcactacgccctgaccatcttccagagcatcgagtacgccgacgagcagggccagatgcagctgagcaccttcttcagcttcatgctggagaactacacccacatccacaaggaggagctggagctgagaaaccagagcctggagagcgagcaggacatgagagacagatgggactacgtggacagcatcgacgtgcccgacagctacaacggccccagactgcagttccccctgacctgcaccgacatcgacctgctgctggaggccttcaaggagcagcagatcctgcacgcccactacgtgctggaggtgctgttcgagaccaagaaggtgctgaagcagatgcccaacttcacccacatccagaccagccccagcaaggaggtgaccatctgcggcgacctgcacggcaagctggacgacctgttcctgatcttctacaagaacggcctgcccagcgagagaaacccctacgtgttcaacggcgacttcgtggacagaggcaagaacagcatcgagatcctgatgatcctgtgcgtgagcttcctggtgtaccccaacgacctgcacctgaacagaggcaaccacgaggacttcatgatgaacctgagatacggcttcaccaaggagatcctgcacaagtacaagctgcacggcaagagaatcctgcagatcctggaggagttctacgcctggctgcccatcggcaccatcgtggacaacgagatcctggtgatccacggcggcatcagcgagaccaccgacctgaacctgctgcacagagtggagagaaacaagatgaagagcgtgctgatcccccccaccgagaccaacagagaccacgacaccgacagcaagcacaacaaggtgggcgtgaccttcaacgcccacggcagaatcaagaccaacggcagccccaccgagcacctgaccgagcacgagtgggagcagagcggctactacggcaagcagagacaccaggacatcaagagagagagcgacttcaccaagaagtag

SEQ ID NO: 95415 - DNA, 1767 bp, Artificial Sequence
  Description of Artificial Sequence: Synthetic coding sequence
atgctggagaactacacccacatccacaaggaggagctggagctgagaaaccagagcctggagagcgagcaggacatgagagacagatgggactacgtggacagcatcgacgtgcccgacagctacaacggccccagactgcagttccccctgacctgcaccgacatcgacctgctgctggaggccttcaaggagcagcagatcctgcacgcccactacgtgctggaggtgctgttcgagaccaagaaggtgctgaagcagatgcccaacttcacccacatccagaccagccccagcaaggaggtgaccatctgcggcgacctgcacggcaagctggacgacctgttcctgatcttctacaagaacggcctgcccagcgagagaaacccctacgtgttcaacggcgacttcgtggacagaggcaagaacagcatcgagatcctgatgatcctgtgcgtgagcttcctggtgtaccccaacgacctgcacctgaacagaggcaaccacgaggacttcatgatgaacctgagatacggcttcaccaaggagatcctgcacaagtacaagctgcacggcaagagaatcctgcagatcctggaggagttctacgcctggctgcccatcggcaccatcgtggacaacgagatcctggtgatccacggcggcatcagcgagaccaccgacctgaacctgctgcacagagtggagagaaacaagatgaagagcgtgctgatcccccccaccgagaccaacagagaccacgacaccgacagcaagcacaacaaggtgggcgtgaccttcaacgcccacggcagaatcaagaccaacggcagccccaccgagcacctgaccgagcacgagtgggagcagatcatcgacatcctgtggagcgaccccagaggcaagaacggctgcttccccaacacctgcagaggcggcggctgctacttcggccccgacgtgaccagcaagatcctgaacaagtaccagctgaagatgctgatcagaagccacgagtgcaagcccgagggctacgagatctgccacgacggcaaggtggtgaccatcttcagcgccagcaactactacgaggagggcagcaacagaggcgcctacatcaagctgtgcagcggcaccacccccagattcttccagtaccaggtgaccaaggccacctgcttccagcccctgagacagagagtggacaccatggagaacagcgccatcaagatcctgagagagagagtgatcagcagaaagagcgacctgaccagagccttccagctgcaggaccacagaaagagcggcaagctgagcgtgagccagtgggccttctgcatggagaacatcctgggcctgaacctgccctggagaagcctgagcagcaacctggtgaacatcgaccagaacggcaacgtggagtacatgagcagcttccagaacatcagaatcgagaagcccgtgcaggaggcccacagcaccctggtggagaccctgtacagatacagaagcgacctggagatcatcttcaacgccatcgacaccgaccacagcggcctgatcagcgtggaggagttcagagccatgtggaagctgttcagcagccactacaacgtgcacatcgacgacagccaggtgaacaagctggccaacatcatggacctgaacaaggacggcagcatcgacttcaacgagttcctgaaggccttctacgtggtgcacagatacgaggacctgatgaagcccgacgtgaccaacctgggctag

SEQ ID NO: 95416 - DNA, 2262 bp, Artificial Sequence
  Description of Artificial Sequence: Synthetic coding sequence
atgggcagcggcaccagcacccagcaccacttcgccttccagaacgccgagagagccttcaaggccgccgccctgatccagagatggtacagaagatacgtggccagactggagatgagaagaagatgcacctggagcatcttccagagcatcgagtacgccggccagcaggaccaggtgaagctgcacgacttcttcagctacctgatggaccacttcatccccagcagccacaacgacagagacttcctgaccagaatcttcaccgaggacagattcgcccaggacagcgagatgaagaagtgcagcgactacgagagcatcgaggtgcccgacagctacaccggccccagactgagcttccccctgctgcccgaccacgccaccgccctggtggaggccttcagactgaagcagcagctgcacgccagatacgtgctgaacctgctgtacgagaccaagaagcacctggtgcagctgcccaacatcaacagagtgagcacctgctacagcgaggagatcaccgtgtgcggcgacctgcacggccagctggacgacctgatcttcatcttctacaagaacggcctgcccagccccgagagaagctacgtgttcaacggcgacttcgtggacagaggcaaggacagcgtggagatcctgatgatcctgttcgccttcatgctggtgtaccccaaggagttccacctgaacagaggcaaccacgaggaccacatggtgaacctgagatacggcttcaccaaggaggtgatgaacaagtacaaggtgcacggcaaggagatcctgagaaccctgcaggacgtgttctgctggctgcccctggccaccctgatcgacgagaaggtgctgatcctgcacggcggcgtgagcgacatcaccgacctggagctgctggacaagatcgagagaagcaagatcgtgagcaccatgagatgcaagaccagacagaagagcgagaagcagatggaggagaagagaagagccaaccagaagagcagcgcccagggccccatcccctggttcctgcccgagagcagaagcctgcccagcagccccctgagactgggcagctacaaggcccagaagaccagcagaagcagcagcatcccctgcagcggcagcctggacggcagagagctgagcagacaggtgagaagcagcgtggagctggagctggagagatgcagacagcaggccggcctgctggtgaccggcgagaaggaggagcccagcagaagcgccagcgaggccgacagcgaggccggcgagctgagaaagcccacccaggaggagtggagacaggtggtggacatcctgtggagcgaccccatggcccaggagggctgcaaggccaacaccatcagaggcggcggctgctacttcggccccgacgtgacccagcagctgctgcagaagtacaacatgcagttcctgatcagaagccacgagtgcaagcccgagggctacgagttctgccacaacagaaaggtgctgaccatcttcagcgccagcaactactacgaggtgggcagcaacagaggcgcctacgtgaagctgggccccgccctgaccccccacatcgtgcagtaccaggccaacaaggtgacccacaccctgaccatgagacagagaatcagcagagtggaggagagcgccctgagagccctgagagagaagctgttcgcccacagcagcgacctgctgagcgagttcaagaagcacgacgccgacaaggtgggcctgatcaccctgagcgactgggccgccgccgtggagagcgtgctgcacctgggcctgccctggagaatgctgagaccccagctggtgaacagcagcgccgacaacatgctggagtacaagagctggctgaagaacctggccaaggagcagctgagcagagagaacatccagagcagcctgctggagaccctgtacagaaacagaagcaacctggagaccatcttcagaatcatcgacagcgaccacagcggcttcatcagcctggacgagttcagacagacctggaagctgttcagcagccacatgaacatcgacatcaccgacgactgcatctgcgacctggccagaagcatcgacttcaacaaggacggccacatcgacatcaacgagttcctggaggccttcagactggtggagaagagctgccccgagggcgacgccagcgagtgcccccaggccaccaacgccaaggacagcggctgcagcagccccggcgcccactag

SEQ ID NO: 95417 - DNA, 1797 bp, Artificial Sequence
  Description of Artificial Sequence: Synthetic coding sequence
atgggcagcggcaccagcacccagcaccacttcgccttccagaacgccgagagagccttcaaggccgccgccctgatccagagatggtacagaagatacgtggccagactggagatgagaagaagatgcacctggagcatcttccagagcatcgagtacgccggccagcaggaccaggtgaagctgcacgacttcttcagctacctgatggaccacttcatccccagcagccacaacgacagagacttcctgaccagaatcttcaccgaggacagattcgcccaggacagcgagatgaagaagtgcagcgactacgagagcatcgaggtgcccgacagctacaccggccccagactgagcttccccctgctgcccgaccacgccaccgccctggtggaggccttcagactgaagcagcagctgcacgccagatacgtgctgaacctgctgtacgagaccaagaagcacctggtgcagctgcccaacatcaacagagtgagcacctgctacagcgaggagatcaccgtgtgcggcgacctgcacggccagctggacgacctgatcttcatcttctacaagaacggcctgcccagccccgagagaagctacgtgttcaacggcgacttcgtggacagaggcaaggacagcgtggagatcctgatgatcctgttcgccttcatgctggtgtaccccaaggagttccacctgaacagaggcaaccacgaggaccacatggtgaacctgagatacggcttcaccaaggaggtgatgaacaagtacaaggtgcacggcaaggagatcctgagaaccctgcaggacgtgttctgctggctgcccctggccaccctgatcgacgagaaggtgctgatcctgcacggcggcgtgagcgacatcaccgacctggagctgctggacaagatcgagagaagcaagatcgtgagcaccatgagatgcaagaccagacagaagagcgagaagcagatggaggagaagagaagagccaaccagaagagcagcgcccagggccccatcccctggttcctgcccgagagcagaagcctgcccagcagccccctgagactgggcagctacaaggcccagaagaccagcagaagcagcagcatcccctgcagcggcagcctggacggcagagagctgagcagacaggtgagaagcagcgtggagctggagctggagagatgcagacagcaggccggcctgctggtgaccggcgagaaggaggagcccagcagaagcgccagcgaggccgacagcgaggccggcgagctgagaaagcccacccaggaggagtggagacaggtggtggacatcctgtggagcgaccccatggcccaggagggctgcaaggccaacaccatcagaggcggcggctgctacttcggccccgacgtgacccagcagctgctgcagaagtacaacatgcagttcctgatcagaagccacgagtgcaagcccgagggctacgagttctgccacaacagaaaggtgctgaccatcttcagcgccagcaactactacgaggtgggcagcaacagaggcgcctacgtgaagctgggccccgccctgaccccccacatcgtgcagtaccaggccaacaaggtgacccacaccctgaccatgagacagagaatcagcagagtggaggagagcgccctgagagccctgagagagaagctgttcgcccacagcagcgacctgctgagcgagttcaagaagcacgacgccgacaaggtgggcctggccagcagccagctgtgctactaccagcagaagtag

SEQ ID NO: 95418 - DNA, 1440 bp, Artificial Sequence
  Description of Artificial Sequence: Synthetic coding sequence
atgggcgccttcctggacaagcccaagaccgagaagcacaacgcccacggcgccggcaacggcctgagatacggcctgagcagcatgcagggctggagagtggagatggaggacgcccacaccgccgtggtgggcatcccccacggcctggaggactggagcttcttcgccgtgtacgacggccacgccggcagcagagtggccaactactgcagcacccacctgctggagcacatcaccaccaacgaggacttcagagccgccggcaagagcggcagcgccctggagctgagcgtggagaacgtgaagaacggcatcagaaccggcttcctgaagatcgacgagtacatgagaaacttcagcgacctgagaaacggcatggacagaagcggcagcaccgccgtgggcgtgatgatcagccccaagcacatctacttcatcaactgcggcgacagcagagccgtgctgtacagaaacggccaggtgtgcttcagcacccaggaccacaagccctgcaaccccagagagaaggagagaatccagaacgccggcggcagcgtgatgatccagagagtgaacggcagcctggccgtgagcagagccctgggcgactacgactacaagtgcgtggacggcaagggccccaccgagcagctggtgagccccgagcccgaggtgtacgagatcctgagagccgaggaggacgagttcatcatcctggcctgcgacggcatctgggacgtgatgagcaacgaggagctgtgcgagtacgtgaagagcagactggaggtgagcgacgacctggagaacgtgtgcaactgggtggtggacacctgcctgcacaagggcagcagagacaacatgagcatcgtgctggtgtgcttcagcaacgcccccaaggtgagcgacgaggccgtgaagaaggacagcgagctggacaagcacctggagagcagagtggaggagatcatggagaagagcggcgaggagggcatgcccgacctggcccacgtgatgagaatcctgagcgccgagaacatccccaacctgccccccggcggcggcctggccggcaagagaaacgtgatcgaggccgtgtacagcagactgaacccccacagagagagcgacggcgccagcgacgaggccgaggagagcggcagccagggcaagctggtggaggccctgagacagatgagaatcaaccacagaggcaactacagacagctgctggaggagatgctgaccagctacagactggccaaggtggagggcgaggagagccccgccgagcccgccgccaccgccaccagcagcaacagcgacgccggcaaccccgtgaccatgcaggagagccacaccgagagcgagagcggcctggccgagctggacagcagcaacgaggacgccggcaccaagatgagcggcgagaagatctag

SEQ ID NO: 95419 - DNA, 579 bp, Artificial Sequence
  Description of Artificial Sequence: Synthetic coding sequence
atgagcatcgtgctggtgtgcttcagcaacgcccccaaggtgagcgacgaggccgtgaagaaggacagcgagctggacaagcacctggagagcagagtggaggagatcatggagaagagcggcgaggagggcatgcccgacctggcccacgtgatgagaatcctgagcgccgagaacatccccaacctgccccccggcggcggcctggccggcaagagaaacgtgatcgaggccgtgtacagcagactgaacccccacagagagagcgacggcgccagcgacgaggccgaggagagcggcagccagggcaagctggtggaggccctgagacagatgagaatcaaccacagaggcaactacagacagctgctggaggagatgctgaccagctacagactggccaaggtggagggcgaggagagccccgccgagcccgccgccaccgccaccagcagcaacagcgacgccggcaaccccgtgaccatgcaggagagccacaccgagagcgagagcggcctggccgagctggacagcagcaacgaggacgccggcaccaagatgagcggcgagaagatctag

SEQ ID NO: 95420 - DNA, 1164 bp, Artificial Sequence
  Description of Artificial Sequence: Synthetic coding sequence
atgggcgccttcctggacaagcccaagaccgagaagcacaacgcccacggcgccggcaacggcctgagatacggcctgagcagcatgcagggctggagagtggagatggaggacgcccacaccgccgtggtgggcatcccccacggcctggaggactggagcttcttcgccgtgtacgacggccacgccggcagcagagtggccaactactgcagcacccacctgctggagcacatcaccaccaacgaggacttcagagccgccggcaagagcggcagcgccctggagctgagcgtggagaacgtgaagaacggcatcagaaccggcttcctgaagatcgacgagtacatgagaaacttcagcgacctgagaaacggcatggacagaagcggcagcaccgccgtgggcgtgatgatcagccccaagcacatctacttcatcaactgcggcgacagcagagccgtgctgtacagaaacggccaggtgtgcttcagcacccaggaccacaagccctgcaaccccagagagaaggagagaatccagaacgccggcggcagcgtgatgatccagagagtgaacggcagcctggccgtgagcagagccctgggcgactacgactacaagtgcgtggacggcaagggccccaccgagcagctggtgagccccgagcccgaggtgtacgagatcctgagagccgaggaggacgagttcatcatcctggcctgcgacggcatctgggacgtgatgagcaacgaggagctgtgcgagtacgtgaagagcagactggaggtgagcgacgacctggagaacgtgtgcaactgggtggtggacacctgcctgcacaagggcagcagagacaacatgagcatcgtgctggtgtgcttcagcaacgcccccaaggtgagcgacgaggccgtgaagaaggacagcgagctggacaagcacctggagagcagagtggaggagatcatggagaagagcggcgaggagggcatgcccgacctggcccacgtgatgagaatcctgagcgccgagaacatccccaacctgccccccggcggcggcctggccggcaagagaaacgtgatcgaggccgtgtacagcagactgaacccccacagagagagcgacggcggcgccggcgacctggaggacccctggtag

SEQ ID NO: 95421 - DNA, 1143 bp, Artificial Sequence
  Description of Artificial Sequence: Synthetic coding sequence
atgggcgccttcctggacaagcccaagaccgagaagcacaacgcccacggcgccggcaacggcctgagatacggcctgagcagcatgcagggctggagagtggagatggaggacgcccacaccgccgtggtgggcatcccccacggcctggaggactggagcttcttcgccgtgtacgacggccacgccggcagcagagtggccaactactgcagcacccacctgctggagcacatcaccaccaacgaggacttcagagccgccggcaagagcggcagcgccctggagctgagcgtggagaacgtgaagaacggcatcagaaccggcttcctgaagatcgacgagtacatgagaaacttcagcgacctgagaaacggcatggacagaagcggcagcaccgccgtgggcgtgatgatcagccccaagcacatctacttcatcaactgcggcgacagcagagccgtgctgtacagaaacggccaggtgtgcttcagcacccaggaccacaagccctgcaaccccagagagaaggagagaatccagaacgccggcggcagcgtgatgatccagagagtgaacggcagcctggccgtgagcagagccctgggcgactacgactacaagtgcgtggacggcaagggccccaccgagcagctggtgagccccgagcccgaggtgtacgagatcctgagagccgaggaggacgagttcatcatcctggcctgcgacggcatctgggacgtgatgagcaacgaggagctgtgcgagtacgtgaagagcagactggaggtgagcgacgacctggagaacgtgtgcaactgggtggtggacacctgcctgcacaagggcagcagagacaacatgagcatcgtgctggtgtgcttcagcaacgcccccaaggtgagcgacgaggccgtgaagaaggacagcgagctggacaagcacctggagagcagagtggaggagatcatggagaagagcggcgaggagggcatgcccgacctggcccacgtgatgagaatcctgagcgccgagaacatccccaacctgccccccggcggcggcctggccggcaagagaaacgtgatcgaggccgtgtacagcagactgaacccccacagagagagcgacggccagaagtag

SEQ ID NO: 95422 - DNA, 984 bp, Artificial Sequence
  Description of Artificial Sequence: Synthetic coding sequence
atgggcgccttcctggacaagcccaagaccgagaagcacaacgcccacggcgccggcaacggcctgagatacggcctgagcagcatgcagggctggagagtggagatggaggacgcccacaccgccgtggtgggcatcccccacggcctggaggactggagcttcttcgccgtgtacgacggccacgccggcagcagagtggccaactactgcagcacccacctgctggagcacatcaccaccaacgaggacttcagagccgccggcaagagcggcagcgccctggagctgagcgtggagaacgtgaagaacggcatcagaaccggcttcctgaagatcgacgagtacatgagaaacttcagcgacctgagaaacggcatggacagaagcggcagcaccgccgtgggcgtgatgatcagccccaagcacatctacttcatcaactgcggcgacagcagagccgtgctgtacagaaacggccaggtgtgcttcagcacccaggaccacaagccctgcaaccccagagagaaggagagaatccagaacgccggcggcagcgtgatgatccagagagtgaacggcagcctggccgtgagcagagccctgggcgactacgactacaagtgcgtggacggcaagggccccaccgagcagctggtgagccccgagcccgaggtgtacgagatcctgagagccgaggaggacgagttcatcatcctggcctgcgacggcatctgggacgtgatgagcaacgaggagctgtgcgagtacgtgaagagcagactggaggtgagcgacgacctggagaacgtgtgcaactgggtggtggacacctgcctgcacaagggcagcagagacaacatgagcatcgtgctggtgtgcttcagcaacgcccccaaggtgagcgacgaggccgtgaagaaggacagcgagctggacaagcacctggagagcagagtggagggcaagaccaacgccttctag

SEQ ID NO: 95423 - DNA, 1137 bp, Artificial Sequence
  Description of Artificial Sequence: Synthetic coding sequence
atgggcgccttcctggacaagcccaagaccgagaagcacaacgcccacggcgccggcaacggcctgagatacggcctgagcagcatgcagggctggagagtggagatggaggacgcccacaccgccgtggtgggcatcccccacggcctggaggactggagcttcttcgccgtgtacgacggccacgccggcagcagagtggccaactactgcagcacccacctgctggagcacatcaccaccaacgaggacttcagagccgccggcaagagcggcagcgccctggagctgagcgtggagaacgtgaagaacggcatcagaaccggcttcctgaagatcgacgagtacatgagaaacttcagcgacctgagaaacggcatggacagaagcggcagcaccgccgtgggcgtgatgatcagccccaagcacatctacttcatcaactgcggcgacagcagagccgtgctgtacagaaacggccaggtgtgcttcagcacccaggaccacaagccctgcaaccccagagagaaggagagaatccagaacgccggcggcagcgtgatgatccagagagtgaacggcagcctggccgtgagcagagccctgggcgactacgactacaagtgcgtggacggcaagggccccaccgagcagctggtgagccccgagcccgaggtgtacgagatcctgagagccgaggaggacgagttcatcatcctggcctgcgacggcatctgggacgtgatgagcaacgaggagctgtgcgagtacgtgaagagcagactggaggtgagcgacgacctggagaacgtgtgcaactgggtggtggacacctgcctgcacaagggcagcagagacaacatgagcatcgtgctggtgtgcttcagcaacgcccccaaggtgagcgacgaggccgtgaagaaggacagcgagctggacaagcacctggagagcagagtggaggagatcatggagaagagcggcgaggagggcatgcccgacctggcccacgtgatgagaatcctgagcgccgagaacatccccaacctgccccccggcggcggcctggccggcaagagaaacgtgatcgaggccgtgtacagcagactgaacccccacagagagagcgacggctag

SEQ ID NO: 95424 - DNA, 1518 bp, Artificial Sequence
  Description of Artificial Sequence: Synthetic coding sequence
atgctgaacagagtgagaagcgccgtggcccacctggtgagcagcggcggcgcccccccccccagacccaagagccccgacctgcccaacgccgccagcgccccccccgccgccgcccccgaggcccccagaagcccccccgccaaggccggcagcggcagcgccacccccgccaaggccgtggaggccagagccagcttcagcagacccaccttcctgcagctgagccccggcggcctgagaagagccgacgaccacgccggcagagccgtgcagagcccccccgacaccggcagaagactgccctggagcaccggctacgccgaggtgatcaacgccggcaagagcagacacaacgaggaccaggcctgctgcgaggtggtgtacgtggagggcagaagaagcgtgaccggcgtgcccagagagcccagcagaggccagggcctgtgcttctactactggggcctgttcgacggccacgccggcggcggcgccgccgagatggccagcagactgctgcacagacacatcagagagcagctgaaggacctggtggagatcctgcaggaccccagccccccccccctgtgcctgcccaccacccccggcacccccgacagcagcgaccccagccacctgctgggcccccagagctgctggagcagccagaaggaggtgagccacgagagcctggtggtgggcgccgtggagaacgccttccagctgatggacgagcagatggccagagagagaagaggccaccaggtggagggcggctgctgcgccctggtggtgatctacctgctgggcaaggtgtacgtggccaacgccggcgacagcagagccatcatcgtgagaaacggcgagatcatccccatgagcagagagttcacccccgagaccgagagacagagactgcagctgctgggcttcctgaagcccgagctgctgggcagcgagttcacccacctggagttccccagaagagtgctgcccaaggagctgggccagagaatgctgtacagagaccagaacatgaccggctgggcctacaagaagatcgagctggaggacctgagattccccctggtgtgcggcgagggcaagaaggccagagtgatggccaccatcggcgtgaccagaggcctgggcgaccacagcctgaaggtgtgcagcagcaccctgcccatcaagcccttcctgagctgcttccccgaggtgagagtgtacgacctgacccagtacgagcactgccccgacgacgtgctggtgctgggcaccgacggcctgtgggacgtgaccaccgactgcgaggtggccgccaccgtggacagagtgctgagcgcctacgagcccaacgaccacagcagatacaccgccctggcccaggccctggtgctgggcgccagaggcacccccagagacagaggctggagactgcccaacaacaagctgggcagcggcgacgacatcagcgtgttcgtgatccccctgggcggccccggcagctacagctag

SEQ ID NO: 95425 - DNA, 900 bp, Artificial Sequence
  Description of Artificial Sequence: Synthetic coding sequence
atggccagcagactgctgcacagacacatcagagagcagctgaaggacctgaaggaggtgagccacgagagcctggtggtgggcgccgtggagaacgccttccagctgatggacgagcagatggccagagagagaagaggccaccaggtggagggcggctgctgcgccctggtggtgatctacctgctgggcaaggtgtacgtggccaacgccggcgacagcagagccatcatcgtgagaaacggcgagatcatccccatgagcagagagttcacccccgagaccgagagacagagactgcagctgctgggcttcctgaagcccgagctgctgggcagcgagttcacccacctggagttccccagaagagtgctgcccaaggagctgggccagagaatgctgtacagagaccagaacatgaccggctgggcctacaagaagatcgagctggaggacctgagattccccctggtgtgcggcgagggcaagaaggccagagtgatggccaccatcggcgtgaccagaggcctgggcgaccacagcctgaaggtgtgcagcagcaccctgcccatcaagcccttcctgagctgcttccccgaggtgagagtgtacgacctgacccagtacgagcactgccccgacgacgtgctggtgctgggcaccgacggcctgtgggacgtgaccaccgactgcgaggtggccgccaccgtggacagagtgctgagcgcctacgagcccaacgaccacagcagatacaccgccctggcccaggccctggtgctgggcgccagaggcacccccagagacagaggctggagactgcccaacaacaagctgggcagcggcgacgacatcagcgtgttcgtgatccccctgggcggccccggcagctacagctag

SEQ ID NO: 95426 - DNA, 1119 bp, Artificial Sequence
  Description of Artificial Sequence: Synthetic coding sequence
atgagcaccgccgccctgatcaccctggtgagaagcggcggcaaccaggtgagaagaagagtgctgctgagcagcagactgctgcaggacgacagaagagtgacccccacctgccacagcagcaccagcgagcccagatgcagcagattcgaccccgacggcagcggcagccccgccacctgggacaacttcggcatctgggacaacagaatcgacgagcccatcctgctgccccccagcatcaagtacggcaagcccatccccaagatcagcctggagaacgtgggctgcgccagccagatcggcaagagaaaggagaacgaggacagattcgacttcgcccagctgaccgacgaggtgctgtacttcgccgtgtacgacggccacggcggccccgccgccgccgacttctgccacacccacatggagaagtgcatcatggacctgctgcccaaggagaagaacctggagaccctgctgaccctggccttcctggagatcgacaaggccttcagcagccacgccagactgagcgccgacgccaccctgctgaccagcggcaccaccgccaccgtggccctgctgagagacggcatcgagctggtggtggccagcgtgggcgacagcagagccatcctgtgcagaaagggcaagcccatgaagctgaccatcgaccacacccccgagagaaaggacgagaaggagagaatcaagaagtgcggcggcttcgtggcctggaacagcctgggccagccccacgtgaacggcagactggccatgaccagaagcatcggcgacctggacctgaagaccagcggcgtgatcgccgagcccgagaccaagagaatcaagctgcaccacgccgacgacagcttcctggtgctgaccaccgacggcatcaacttcatggtgaacagccaggagatctgcgacttcgtgaaccagtgccacgaccccaacgaggccgcccacgccgtgaccgagcaggccatccagtacggcaccgaggacaacagcaccgccgtggtggtgcccttcggcgcctggggcaagtacaagaacagcgagatcaacttcagcttcagcagaagcttcgccagcagcggcagatgggcctag

SEQ ID NO: 95427 - DNA, 702 bp, Artificial Sequence
  Description of Artificial Sequence: Synthetic coding sequence
atgagcaccgccgccctgatcaccctggtgagaagcggcggcaaccaggtgagaagaagagtgctgctgagcagcagactgctgcaggacgacagaagagtgacccccacctgccacagcagcaccagcgagcccagatgcagcagattcgaccccgacggcagcggcagccccgccacctgggacaacttcggcatctgggacaacagaatcgacgagcccatcctgctgccccccagcatcaagtacggcaagcccatccccaagatcagcctggagaacgtgggctgcgccagccagatcggcaagagaaaggagaacgaggacagattcgacttcgcccagctgaccgacgaggtgctgtacttcgccgtgtacgacggccacggcggccccgccgccgccgacttctgccacacccacatggagaagtgcatcatggacctgctgcccaaggagaagaacctggagaccctgctgaccctggccttcctggagatcgacaaggccttcagcagccacgccagactgagcgccgacgagaactgcgcctggagcgccgccctggacctggagcccgtggacaccatctgcggcgccagcgtggagagagagatctgcctgatcctgagccaggtgaaggagagcagcggcagctaccccggcctgagagagggcagccacatcagcctgagccactag

SEQ ID NO: 95428 - DNA, 702 bp, Artificial Sequence; identical to SEQ ID NO: 95427
  Description of Artificial Sequence: Synthetic coding sequence

SEQ ID NO: 95429 - DNA, 585 bp, Artificial Sequence
  Description of Artificial Sequence: Synthetic coding sequence
atgatcgaggacaccatgaccctgctgagcctgctgggcagaatcatgagatacttcctgctgagacccgagaccctgttcctgctgtgcatcagcctggccctgtggagctacttcttccacaccgacgaggtgaagaccatcgtgaagagcagcagagacgccgtgaagatggtgaagggcaaggtggccgagatcatgcagaacgacagactgggcggcctggacgtgctggaggccgagttcagcaagacctgggagttcaagaaccacaacgtggccgtgtacagcatccagggcagaagagaccacatggaggacagattcgaggtgctgaccgacctggccaacaagacccaccccagcatcttcggcatcttcgacggccacggcggcgagaccgccgccgagtacgtgaagagcagactgcccgaggccctgaagcagcacctgcaggactacgagaaggacaaggagaacagcgtgctgagctaccagaccatcctggagcagcagatcctgagcatcgacagagagatgctggagaagctgaccgtgagctacgacgaggccgtgaccttctag

SEQ ID NO: 95430 - DNA, 1083 bp, Artificial Sequence
  Description of Artificial Sequence: Synthetic coding sequence
atgatcgaggacaccatgaccctgctgagcctgctgggcagaatcatgagatacttcctgctgagacccgagaccctgttcctgctgtgcatcagcctggccctgtggagctacttcttccacaccgacgaggtgaagaccatcgtgaagagcagcagagacgccgtgaagatggtgaagggcaaggtggccgagatcatgcagaacgacagactgggcggcctggacgtgctggaggccgagttcagcaagacctgggagttcaagaaccacaacgtggccgtgtacagcatccagggcagaagagaccacatggaggacagattcgaggtgctgaccgacctggccaacaagacccaccccagcatcttcggcatcttcgacggccacggcggcgagaccgccgccgagtacgtgaagagcagactgcccgaggccctgaagcagcacctgcaggactacgagaaggacaaggagaacagcgtgctgagctaccagaccatcctggagcagcagatcctgagcatcgacagagagatgctggagaagctgaccgtgagctacgacgaggccggcaccacctgcctgatcgccctgctgagcgacaaggacctgaccgtggccaacgtgggcgacagcagaggcgtgctgtgcgacaaggacggcaacgccatccccctgagccacgaccacaagccctaccagctgaaggagagaaagagaatcaagagagccggcggcttcatcagcttcaacggcagctggagagtgcagggcatcctggccatgagcagaagcctgggcgactaccccctgaagaacctgaacgtggtgatccccgaccccgacatcctgaccttcgacctggacaagctgcagcccgagttcatgatcctggccagcgacggcctgtgggacgccttcagcaacgaggaggccgtgagattcatcaaggagagactggacgagccccacttcggcgccaagagcatcgtgctgcagagcttctacagaggctgccccgacaacatcaccgtgatggtggtgaagttcagaaacagcagcaagaccgaggagcagtag

SEQ ID NO: 95431 - DNA, 813 bp, Artificial Sequence
  Description of Artificial Sequence: Synthetic coding sequence
atgcacctgaacggcagatgcatctgccccagcgacccccagttcgtggaggagaagggcatcagagccgaggacctggtgatcggcgccctggagagcgccttccaggagtgcgacgaggtgatcggcagagagctggaggccagcggccagatgggcggctgcaccgccctggtggccgtgagcctgcagggcaagctgtacatggccaacgccggcgacagcagagccatcctggtgagaagagacgagatcagacccctgagcttcgagttcacccccgagaccgagagacagagaatccagcagctggccttcgtgtaccccgagctgctggccggcgagttcaccagactggagttccccagaagactgaagggcgacgacctgggccagaaggtgctgttcagagaccaccacatgagcggctggagctacaagagagtggagaagagcgacctgaagtaccccctgatccacggccagggcagacaggccagactgctgggcaccctggccgtgagcagaggcctgggcgaccaccagctgagagtgctggacaccaacatccagctgaagcccttcctgctgagcgtgccccaggtgaccgtgctggacgtggaccagctggagctgcaggaggacgacgtggtggtgatggccaccgacggcctgtgggacgtgctgagcaacgagcaggtggcctggctggtgagaagcttcctgcccggcaaccaggaggacccccacagatactgcagctgctggggccccgcctgggcctgggtgggcgccagcagcaagcccaagtag

SEQ ID NO: 95432 - DNA, 897 bp, Artificial Sequence
  Description of Artificial Sequence: Synthetic coding sequence
atgcacctgaacggcagatgcatctgccccagcgacccccagttcgtggaggagaagggcatcagagccgaggacctggtgatcggcgccctggagagcgccttccaggagtgcgacgaggtgatcggcagagagctggaggccagcggccagatgggcggctgcaccgccctggtggccgtgagcctgcagggcaagctgtacatggccaacgccggcgacagcagagccatcctggtgagaagagacgagatcagacccctgagcttcgagttcacccccgagaccgagagacagagaatccagcagctggccttcgtgtaccccgagctgctggccggcgagttcaccagactggagttccccagaagactgaagggcgacgacctgggccagaaggtgctgttcagagaccaccacatgagcggctggagctacaagagagtggagaagagcgacctgaagtaccccctgatccacggccagggcagacaggccagactgctgggcaccctggccgtgagcagaggcctgggcgaccaccagctgagagtgctggacaccaacatccagctgaagcccttcctgctgagcgtgccccaggtgaccgtgctggacgtggaccagctggagctgcaggaggacgacgtggtggtgatggccaccgacggcctgtgggacgtgctgagcaacgagcaggtggcctggctggtgagaagcttcctgcccggcaaccaggaggacccccacagattcagcaagctggcccagatgctgatccacagcacccagggcaaggaggacagcctgaccgaggagggccaggtgagctacgacgacgtgagcgtgttcgtgatccccctgcacagccagggccaggagagcagcgaccactag

SEQ ID NO: 95433 - DNA, 744 bp, Artificial Sequence
  Description of Artificial Sequence: Synthetic coding sequence
atgggcggctgcaccgccctggtggccgtgagcctgcagggcaagctgtacatggccaacgccggcgacagcagagccatcctggtgagaagagacgagatcagacccctgagcttcgagttcacccccgagaccgagagacagagaatccagcagctggccttcgtgtaccccgagctgctggccggcgagttcaccagactggagttccccagaagactgaagggcgacgacctgggccagaaggtgctgttcagagaccaccacatgagcggctggagctacaagagagtggagaagagcgacctgaagtaccccctgatccacggccagggcagacaggccagactgctgggcaccctggccgtgagcagaggcctgggcgaccaccagctgagagtgctggacaccaacatccagctgaagcccttcctgctgagcgtgccccaggtgaccgtgctggacgtggaccagctggagctgcaggaggacgacgtggtggtgatggccaccgacggcctgtgggacgtgctgagcaacgagcaggtggcctggctggtgagaagcttcctgcccggcaaccaggaggacccccacagattcagcaagctggcccagatgctgatccacagcacccagggcaaggaggacagcctgaccgaggagggccaggtgagctacgacgacgtgagcgtgttcgtgatccccctgcacagccagggccaggagagcagcgaccactag

SEQ ID NO: 95434 - DNA, 1380 bp, Artificial Sequence
  Description of Artificial Sequence: Synthetic coding sequence
atgagcgccggctggttcagaagaagattcctgcccggcgagcccctgcccgcccccagaccccccggcccccacgccagccccgtgccctacagaagacccagattcctgagaggcagcagcagcagccccggcgccgccgacgccagcagaagacccgacagcagacccgtgagaagccccgccagaggcagaaccctgccctggaacgccggctacgccgagatcatcaacgccgagaagagcgagttcaacgaggaccaggccgcctgcggcaagctgtgcatcagaagatgcgagttcggcgccgaggaggagtggctgaccctgtgccccgaggagttcctgaccggccactactgggccctgttcgacggccacggcggccccgccgccgccatcctggccgccaacaccctgcacagctgcctgagaagacagctggaggccgtggtggagggcctggtggccacccagccccccatgcacctgaacggcagatgcatctgccccagcgacccccagttcgtggaggagaagggcatcagagccgaggacctggtgatcggcgccctggagagcgccttccaggagtgcgacgaggtgatcggcagagagctggaggccagcggccagatgggcggctgcaccgccctggtggccgtgagcctgcagggcaagctgtacatggccaacgccggcgacagcagagccatcctggtgagaagagacgagatcagacccctgagcttcgagttcacccccgagaccgagagacagagaatccagcagctggccttcgtgtaccccgagctgctggccggcgagttcaccagactggagttccccagaagactgaagggcgacgacctgggccagaaggtgctgttcagagaccaccacatgagcggctggagctacaagagagtggagaagagcgacctgaagtaccccctgatccacggccagggcagacaggccagactgctgggcaccctggccgtgagcagaggcctgggcgaccaccagctgagagtgctggacaccaacatccagctgaagcccttcctgctgagcgtgccccaggtgaccgtgctggacgtggaccagctggagctgcaggaggacgacgtggtggtgatggccaccgacggcctgtgggacgtgctgagcaacgagcaggtggcctggctggtgagaagcttcctgcccggcaaccaggaggacccccacagattcagcaagctggcccagatgctgatccacagcacccagggcaaggaggacagcctgaccgaggagggccaggtgagctacgacgacgtgagcgtgttcgtgatccccctgcacagccagggccaggagagcagcgaccactag

SEQ ID NO: 95435 - DNA, 1821 bp, Artificial Sequence
  Description of Artificial Sequence: Synthetic coding sequence
atgagaagaagcgaggtgctggccgaggagagcatcgtgtgcctgcagaaggccctgaaccacctgagagagatctgggagctgatcggcatccccgaggaccagagactgcagagaaccgaggtggtgaagaagcacatcaaggagctgctggacatgatgatcgccgaggaggagagcctgaaggagagactgatcaagagcatcagcgtgtgccagaaggagctgaacaccctgtgcagcgagctgcacgtggagcccttccaggaggagggcgagaccaccatcctgcagctggagaaggacctgagaacccaggtggagctgatgagaaagcagaagaaggagagaaagcaggagctgaagctgctgcaggagcaggaccaggagctgtgcgagatcctgtgcatgccccactacgacatcgacagcgccagcgtgcccagcctggaggagctgaaccagttcagacagcacgtgaccaccctgagagagaccaaggccagcagaagagaggagttcgtgagcatcaagagacagatcatcctgtgcatggaggccctggaccacacccccgacaccagcttcgagagagacgtggtgtgcgaggacgaggacgccttctgcctgagcctggagaacatcgccaccctgcagaagctgctgagacagctggagatgcagaagagccagaacgaggccgtgtgcgagggcctgagaacccagatcagagagctgtgggacagactgcagatccccgaggaggagagagaggccgtggccaccatcatgagcggcagcaaggccaaggtgagaaaggccctgcagctggaggtggacagactggaggagctgaagatgcagaacatgaagaaggtgatcgaggccatcagagtggagctggtgcagtactgggaccagtgcttctacagccaggagcagagacaggccttcgcccccttctgcgccgaggactacaccgagagcctgctgcagctgcacgacgccgagatcgtgagactgaagaactactacgaggtgcacaaggagctgttcgagggcgtgcagaagtgggaggagacctggagactgttcctggagttcgagagaaaggccagcgaccccaacagattcaccaacagaggcggcaacctgctgaaggaggagaagcagagagccaagctgcagaagatgctgcccaagctggaggaggagctgaaggccagaatcgagctgtgggagcaggagcacagcaaggccttcatggtgaacggccagaagttcatggagtacgtggccgagcagtgggagatgcacagactggagaaggagagagccaagcaggagagacagctgaagaacaagaagcagaccgagaccgagatgctgtacggcagcgcccccagaacccccagcaagagaagaggcctggcccccaacacccccggcaaggccagaaagctgaacaccaccaccatgagcaacgccaccgccaacagcagcatcagacccatcttcggcggcaccgtgtaccacagccccgtgagcagactgccccccagcggcagcaagcccgtggccgccagcacctgcagcggcaagaagacccccagaaccggcagacacggcgccaacaaggagaacctggagctgaacggcagcatcctgagcggcggctaccccggcagcgcccccctgcagagaaacttcagcatcaacagcgtggccagcacctacagcgagttcgccagagagctgagcaaggccagcaagagcgacgccaccagcggcatcctgaacagcaccaacatccagagctag

SEQ ID NO: 95436 - DNA, 1701 bp, Artificial Sequence
  Description of Artificial Sequence: Synthetic coding sequence
atgagaagaagcgaggtgctggccgaggagagcatcgtgtgcctgcagaaggccctgaaccacctgagagagatctgggagctgatcggcatccccgaggaccagagactgcagagaaccgaggtggtgaagaagcacatcaaggagctgctggacatgatgatcgccgaggaggagagcctgaaggagagactgatcaagagcatcagcgtgtgccagaaggagctgaacaccctgtgcagcgagctgcacgtggagcccttccaggaggagggcgagaccaccatcctgcagctggagaaggacctgagaacccaggtggagctgatgagaaagcagaagaaggagagaaagcaggagctgaagctgctgcaggagcaggaccaggagctgtgcgagatcctgtgcatgccccactacgacatcgacagcgccagcgtgcccagcctggaggagctgaaccagttcagacagcacgtgaccaccctgagagagaccaaggccagcagaagagaggagttcgtgagcatcaagagacagatcatcctgtgcatggaggccctggaccacacccccgacaccagcttcgagagagacgtggtgtgcgaggacgaggacgccttctgcctgagcctggagaacatcgccaccctgcagaagctgctgagacagctggagatgcagaagagccagaacgaggccgtgtgcgagggcctgagaacccagatcagagagctgtgggacagactgcagatccccgaggaggagagagaggccgtggccaccatcatgagcggcagcaaggccaaggtgagaaaggccctgcagctggaggtggacagactggaggagctgaagatgcagaacatgaagaaggtgatcgaggccatcagagtggagctggtgcagtactgggaccagtgcttctacagccaggagcagagacaggccttcgcccccttctgcgccgaggactacaccgagagcctgctgcagctgcacgacgccgagatcgtgagactgaagaactactacgaggtgcacaaggagctgttcgagggcgtgcagaagtgggaggagacctggagactgttcctggagttcgagagaaaggccagcgaccccaacagattcaccaacagaggcggcaacctgctgaaggaggagaagcagagagccaagctgcagaagatgctgcccaagctggaggaggagctgaaggccagaatcgagctgtgggagcaggagcacagcaaggccttcatggtgaacggccagaagttcatggagtacgtggccgagcagtgggagatgcacagactggagaaggagagagccaagcaggagagacagctgaagaacaagaagcagaccgagaccgagatgctgtacggcagcgcccccagaacccccagcaagagaagaggcctggcccccaacacccccggcaaggccagaaagctgaacaccaccaccatgagcaacgccaccgccaacagcagcatcagacccatcttcggcggcaccgtgtaccacagccccgtgagcagactgccccccagcggcagcaagcccgtggccgccagcacctgcagcggcaagaagacccccagaaccggcagacacggcgccaacaaggagaacctggagctgaacggcagcatcctgagcgccagaaccttcaagggcttccagatctag

SEQ ID NO: 95437 - DNA, 1863 bp, Artificial Sequence
  Description of Artificial Sequence: Synthetic coding sequence
atgagaagaagcgaggtgctggccgaggagagcatcgtgtgcctgcagaaggccctgaaccacctgagagagatctgggagctgatcggcatccccgaggaccagagactgcagagaaccgaggtggtgaagaagcacatcaaggagctgctggacatgatgatcgccgaggaggagagcctgaaggagagactgatcaagagcatcagcgtgtgccagaaggagctgaacaccctgtgcagcgagctgcacgtggagcccttccaggaggagggcgagaccaccatcctgcagctggagaaggacctgagaacccaggtggagctgatgagaaagcagaagaaggagagaaagcaggagctgaagctgctgcaggagcaggaccaggagctgtgcgagatcctgtgcatgccccactacgacatcgacagcgccagcgtgcccagcctggaggagctgaaccagttcagacagcacgtgaccaccctgagagagaccaaggccagcagaagagaggagttcgtgagcatcaagagacagatcatcctgtgcatggaggccctggaccacacccccgacaccagcttcgagagagacgtggtgtgcgaggacgaggacgccttctgcctgagcctggagaacatcgccaccctgcagaagctgctgagacagctggagatgcagaagagccagaacgaggccgtgtgcgagggcctgagaacccagatcagagagctgtgggacagactgcagatccccgaggaggagagagaggccgtggccaccatcatgagcggcagcaaggccaaggtgagaaaggccctgcagctggaggtggacagactggaggagctgaagatgcagaacatgaagaaggtgatcgaggccatcagagtggagctggtgcagtactgggaccagtgcttctacagccaggagcagagacaggccttcgcccccttctgcgccgaggactacaccgagagcctgctgcagctgcacgacgccgagatcgtgagactgaagaactactacgaggtgcacaaggagctgttcgagggcgtgcagaagtgggaggagacctggagactgttcctggagttcgagagaaaggccagcgaccccaacagattcaccaacagaggcggcaacctgctgaaggaggagaagcagagagccaagctgcagaagatgctgcccaagctggaggaggagctgaaggccagaatcgagctgtgggagcaggagcacagcaaggccttcatggtgaacggccagaagttcatggagtacgtggccgagcagtgggagatgcacagactggagaaggagagagccaagcaggagagacagctgaagaacaagaagcagaccgagaccgagatgctgtacggcagcgcccccagaacccccagcaagagaagaggcctggcccccaacacccccggcaaggccagaaagctgaacaccaccaccatgagcaacgccaccgccaacagcagcatcagacccatcttcggcggcaccgtgtaccacagccccgtgagcagactgccccccagcggcagcaagcccgtggccgccagcacctgcagcggcaagaagacccccagaaccggcagacacggcgccaacaaggagaacctggagctgaacggcagcatcctgagcggcggctaccccggcagcgcccccctgcagagaaacttcagcatcaacagcgtggccagcacctacagcgagttcgccaaggaccccagcctgagcgacagcagcaccgtgggcctgcagagagagctgagcaaggccagcaagagcgacgccaccagcggcatcctgaacagcaccaacatccagagctag

SEQ ID NO: 95438 - DNA, 1578 bp, Artificial Sequence
  Description of Artificial Sequence: Synthetic coding sequence
atgagaagaagcgaggtgctggccgaggagagcatcgtgtgcctgcagaaggccctgaaccacctgagagagatctgggagctgatcggcatccccgaggaccagagactgcagagaaccgaggtggtgaagaagcacatcaaggaggagggcgagaccaccatcctgcagctggagaaggacctgagaacccaggtggagctgatgagaaagcagaagaaggagagaaagcaggagctgaagctgctgcaggagcaggaccaggagctgtgcgagatcctgtgcatgccccactacgacatcgacagcgccagcgtgcccagcctggaggagctgaaccagttcagacagcacgtgaccaccctgagagagaccaaggccagcagaagagaggagttcgtgagcatcaagagacagatcatcctgtgcatggaggccctggaccacacccccgacaccagcttcgagagagacgtggtgtgcgaggacgaggacgccttctgcctgagcctggagaacatcgccaccctgcagaagctgctgagacagctggagatgcagaagagccagaacgaggccgtgtgcgagggcctgagaacccagatcagagagctgtgggacagactgcagatccccgaggaggagagagaggccgtggccaccatcatgagcggcagcaaggccaaggtgagaaaggccctgcagctggaggtggacagactggaggagctgaagatgcagaacatgaagaaggtgatcgaggccatcagagtggagctggtgcagtactgggaccagtgcttctacagccaggagcagagacaggccttcgcccccttctgcgccgaggactacaccgagagcctgctgcagctgcacgacgccgagatcgtgagactgaagaactactacgaggtgcacaaggagctgttcgagggcgtgcagaagtgggaggagacctggagactgttcctggagttcgagagaaaggccagcgaccccaacagattcaccaacagaggcggcaacctgctgaaggaggagaagcagagagccaagctgcagaagatgctgcccaagctggaggaggagctgaaggccagaatcgagctgtgggagcaggagcacagcaaggccttcatggtgaacggccagaagttcatggagtacgtggccgagcagtgggagatgcacagactggagaaggagagagccaagcaggagagacagctgaagaacaagaagcagaccgagaccgagatgctgtacggcagcgcccccagaacccccagcaagagaagaggcctggcccccaacacccccggcaaggccagaaagctgaacaccaccaccatgagcaacgccaccgccaacagcagcatcagacccatcttcggcggcaccgtgtaccacagccccgtgagcagactgccccccagcggcagcaagcccgtggccgccagcacctgcagcggcaagaagacccccagaaccggcagacacggcgccaacaaggagaacctggagctgaacggcagcatcctgagcgccagaaccttcaagggcttccagatctag

SEQ ID NO: 95439 - DNA, 696 bp, Artificial Sequence
  Description of Artificial Sequence: Synthetic coding sequence
atgagagtgctgggcggcagatgcggcgccctgctggcctgcctgctgctggtgctgcccgtgagcgaggccaacttctgcctgtacttcagaaacgacttcatctacaacagagcctgcatcagcgtgctggtgggcctgagcggctgcaacttcttctacagcatctgcttcctgagcaagcagcaggccagccaggtgctggtgagaaagagaagagccaacagcctgctggaggagaccaagcagggcaacctggagagagagtgcatcgaggagctgtgcaacaaggaggaggccagagaggtgttcgagaacgaccccgagaccgactacttctaccccaagtacctggtgtgcctgagaagcttccagaccggcctgttcaccgccgccagacagagcaccaacgcctaccccgacctgagaagctgcgtgaacgccatccccgaccagtgcagccccctgccctgcaacgaggacggctacatgagctgcaaggacggcaaggccagcttcacctgcacctgcaagcccggctggcagggcgagaagtgcgagttcgacatcaacgagtgcaaggaccccagcaacatcaacggcggctgcagccagatctgcgacaacacccccggcagctaccactgcagctgcaagaacggcttcgtgatgctgagcaacaagaaggactgctag

SEQ ID NO: 95440 - DNA, 2031 bp, Artificial Sequence
  Description of Artificial Sequence: Synthetic coding sequence
atgagagtgctgggcggcagatgcggcgccctgctggcctgcctgctgctggtgctgcccgtgagcgaggccaacttcctgagcaagcagcaggccagccaggtgctggtgagaaagagaagagccaacagcctgctggaggagaccaagcagggcaacctggagagagagtgcatcgaggagctgtgcaacaaggaggaggccagagaggtgttcgagaacgaccccgagaccgactacttctaccccaagtacctggtgtgcctgagaagcttccagaccggcctgttcaccgccgccagacagagcaccaacgcctaccccgacctgagaagctgcgtgaacgccatccccgaccagtgcagccccctgccctgcaacgaggacggctacatgagctgcaaggacggcaaggccagcttcacctgcacctgcaagcccggctggcagggcgagaagtgcgagttcgacatcaacgagtgcaaggaccccagcaacatcaacggcggctgcagccagatctgcgacaacacccccggcagctaccactgcagctgcaagaacggcttcgtgatgctgagcaacaagaaggactgcaaggacgtggacgagtgcagcctgaagcccagcatctgcggcaccgccgtgtgcaagaacatccccggcgacttcgagtgcgagtgccccgagggctacagatacaacctgaagagcaagagctgcgaggacatcgacgagtgcagcgagaacatgtgcgcccagctgtgcgtgaactaccccggcggctacacctgctactgcgacggcaagaagggcttcaagctggcccaggaccagaagagctgcgaggtggtgagcgtgtgcctgcccctgaacctggacaccaagtacgagctgctgtacctggccgagcagttcgccggcgtggtgctgtacctgaagttcagactgcccgagatcagcagattcagcgccgagttcgacttcagaacctacgacagcgagggcgtgatcctgtacgccgagagcatcgaccacagcgcctggctgctgatcgccctgagaggcggcaagatcgaggtgcagctgaagaacgagcacaccagcaagatcaccaccggcggcgacgtgatcaacaacggcctgtggaacatggtgagcgtggaggagctggagcacagcatcagcatcaagatcgccaaggaggccgtgatggacatcaacaagcccggccccctgttcaagcccgagaacggcctgctggagaccaaggtgtacttcgccggcttccccagaaaggtggagagcgagctgatcaagcccatcaaccccagactggacggctgcatcagaagctggaacctgatgaagcagggcgccagcggcatcaaggagatcatccaggagaagcagaacaagcactgcctggtgaccgtggagaagggcagctactaccccggcagcggcatcgcccagttccacatcgactacaacaacgtgagcagcgccgagggctggcacgtgaacgtgaccctgaacatcagacccagcaccggcaccggcgtgatgctggccctggtgagcggcaacaacaccgtgcccttcgccgtgagcctggtggacagcaccagcgagaagagccaggacatcctgctgagcgtggagaacaccgtgatctacagaatccaggccctgagcctgtgcagcgaccagcagagccacctggagttcagagtgaacagaaacaacctggagctgagcacccccctgaagatcgagaccatcagccacgaggacctgcagagacagctggccgtgctggacaaggccatgaaggccaaggtggccacctacctgggcggcctgcccgacgtgcccttcagcgccacccccgtgaacgccttctacaacggctgcatggaggtgaacatcaacggcgtgcagctggacctggacgaggccatcagcaagcacaacgacatcagagcccacagctgccccagcgtgtggaagaagaccaagaacagctag

SEQ ID NO: 95441 - DNA, 1275 bp, Artificial Sequence
  Description of Artificial Sequence: Synthetic coding sequence
atgggctgcggcaccagcaaggtgctgcccgagccccccaaggacgtgcagctggacctggtgaagaaggtggagcccttcagcggcaccaagagcgacgtgtacaagcacttcatcaccgaggtggacagcgtgggccccgtgaaggccggcttccccgccgccagccagtacgcccacccctgccccggcccccccaccgccggccacaccgagccccccagcgagccccccagaagagccagagtggccaagtacagagccaagttcgaccccagagtgaccgccaagtacgacatcaaggccctgatcggcagaggcagcttcagcagagtggtgagagtggagcacagagccaccagacagccctacgccatcaagatgatcgagaccaagtacagagagggcagagaggtgtgcgagagcgagctgagagtgctgagaagagtgagacacgccaacatcatccagctggtggaggtgttcgagacccaggagagagtgtacatggtgatggagctggccaccggcggcgagctgttcgacagaatcatcgccaagggcagcttcaccgagagagacgccaccagagtgctgcagatggtgctggacggcgtgagatacctgcacgccctgggcatcacccacagagacctgaagcccgagaacctgctgtactaccaccccggcaccgacagcaagatcatcatcaccgacttcggcctggccagcgccagaaagaagggcgacgactgcctgatgaagaccacctgcggcacccccgagtacatcgcccccgaggtgctggtgagaaagccctacaccaacagcgtggacatgtgggccctgggcgtgatcgcctacatcctgctgagcggcaccatgcccttcgaggacgacaacagaaccagactgtacagacagatcctgagaggcaagtacagctacagcggcgagccctggcccagcgtgagcaacctggccaaggacttcatcgacagactgctgaccgtggaccccggcgccagaatgaccgccctgcaggccctgagacacccctgggtggtgagcatggccgccagcagcagcatgaagaacctgcacagaagcatcagccagaacctgctgaagagagccagcagcagatgccagagcaccaagagcgcccagagcaccagaagcagcagaagcaccagaagcaacaagagcagaagagtgagagagagagagctgagagagctgaacctgagataccagcagcagtacaacggctag

SEQ ID NO: 95442 - DNA, 1953 bp, Artificial Sequence
  Description of Artificial Sequence: Synthetic coding sequence
atggcctgcagagagttcgagatgggcagaaagaagtgcgagagatactggcccctgtacggcgaggaccccatcaccttcgcccccttcaagatcagctgcgaggacgagcaggccagaaccgactacttcatcagaaccctgctgctggagttccagaacgagagcagaagactgtaccagttccactacgtgaactggcccgaccacgacgtgcccagcagcttcgacagcatcctggacatgatcagcctgatgagaaagtaccaggagcacgaggacgtgcccatctgcatccactgcagcgccggctgcggcagaaccggcgccatctgcgccatcgactacacctggaacctgctgaaggccggcaagatccccgaggagttcaacgtgttcaacctgatccaggagatgagaacccagagacacagcgccgtgcagaccaaggagcagtacgagctggtgcacagagccatcgcccagctgttcgagaagcagctgcagctgtacgagatccacggcgcccagaagatcgccgacggcgtgaacgagatcaacaccgagaacatggtgagcagcatcgagcccgagaagcaggacagccccccccccaagccccccagaaccagaagctgcctggtggagggcgacgccaaggaggagatcctgcagccccccgagccccaccccgtgccccccatcctgacccccagcccccccagcgccttccccaccgtgaccaccgtgtggcaggacaacgacagataccaccccaagcccgtgctgcacatggtgagcagcgagcagcacagcgccgacctgaacagaaactacagcaagagcaccgagctgcccggcaagaacgagagcaccatcgagcagatcgacaagaagctggagagaaacctgagcttcgagatcaagaaggtgcccctgcaggagggccccaagagcttcgacggcaacaccctgctgaacagaggccacgccatcaagatcaagagcgccagcccctgcatcgccgacaagatcagcaagccccaggagctgagcagcgacctgaacgtgggcgacaccagccagaacagctgcgtggactgcagcgtgacccagagcaacaaggtgagcgtgaccccccccgaggagagccagaacagcgacaccccccccagacccgacagactgcccctggacgagaagggccacgtgacctggagcttccacggccccgagaacgccatccccatccccgacctgagcgagggcaacagcagcgacatcaactaccagaccagaaagaccgtgagcctgacccccagccccaccacccaggtggagacccccgacctggtggaccacgacaacaccagccccctgttcagaacccccctgagcttcaccaaccccctgcacagcgacgacagcgacagcgacgagagaaacagcgacggcgccgtgacccagaacaagaccaacatcagcaccgccagcgccaccgtgagcgccgccaccagcaccgagagcatcagcaccagaaaggtgctgcccatgagcatcgccagacacaacatcgccggcaccacccacagcggcgccgagaaggacgtggacgtgagcgaggacagccccccccccctgcccgagagaacccccgagagcttcgtgctggccagcgagcacaacacccccgtgagaagcgagtggagcgagctgcagagccaggagagaagcgagcagaagaagagcgagggcctgatcaccagcgagaacgagaagtgcgaccaccccgccggcggcatccactacgagatgtgcatcgagtgcccccccaccttcagcgacaagagagagcagatcagcgagaaccccaccgaggccaccgacatcggcttcggcaacagatgcggcaagcccaagggccccagagacccccccagcgagtggacctag

SEQ ID NO: 95443 - DNA, 1062 bp, Artificial Sequence
  Description of Artificial Sequence: Synthetic coding sequence
atgagcagaagcctggacagcgccagaagcttcctggagagactggaggccagaggcggcagagagggcgccgtgctggccggcgagttcagcaagagatgcgagagatactgggcccaggagcaggagcccctgcagaccggcctgttctgcatcaccctgatcaaggagaagtggctgaacgaggacatcatgctgagaaccctgaaggtgaccttccagaaggagagcagaagcgtgtaccagctgcagtacatgagctggcccgacagaggcgtgcccagcagccccgaccacatgctggccatggtggaggaggccagaagactgcagggcagcggccccgagcccctgtgcgtgcactgcagcgccggctgcggcagaaccggcgtgctgtgcaccgtggactacgtgagacagctgctgctgacccagatgatcccccccgacttcagcctgttcgacgtggtgctgaagatgagaaagcagagacccgccgccgtgcagaccgaggagcagtacagattcctgtaccacaccgtggcccagatgttctgcagcaccctgcagaacgccagcccccactaccagaacatcaaggagaactgcgcccccctgtacgacgacgccctgttcctgagaaccccccaggccctgctggccatccccagaccccccggcggcgtgctgagaagcatcagcgtgcccggcagccccggccacgccatggccgacacctacgccgtggtgcagaagagaggcgcccccgccggcgccggcagcggcacccagaccggcaccggcaccggcaccggcgccagaagcgccgaggaggcccccctgtacagcaaggtgacccccagagcccagagacccggcgcccacgccgaggacgccagaggcaccctgcccggcagagtgcccgccgaccagagccccgccggcagcggcgcctacgaggacgtggccggcggcgcccagaccggcggcctgggcttcaacctgagaatcggcagacccaagggccccagagacccccccgccgagtggaccagagtgtag

SEQ ID NO: 95444 - DNA, 1233 bp, Artificial Sequence
  Description of Artificial Sequence: Synthetic coding sequence
atgcccaccaccatcgagagagagttcgaggagctggacacccagagaagatggcagcccctgtacctggagatcagaaacgagagccacgactacccccacagagtggccaagttccccgagaacagaaacagaaacagatacagagacgtgagcccctacgaccacagcagagtgaagctgcagaacgccgagaacgactacatcaacgccagcctggtggacatcgaggaggcccagagaagctacatcctgacccagggccccctgcccaacacctgctgccacttctggctgatggtgtggcagcagaagaccaaggccgtggtgatgctgaacagaatcgtggagaaggagagcgtgaagtgcgcccagtactggcccaccgacgaccaggagatgctgttcaaggagaccggcttcagcgtgaagctgctgagcgaggacgtgaagagctactacaccgtgcacctgctgcagctggagaacatcaactacatcgagaacctgtggatcaccctgtacctgaagctgctgatgctggacgtgaagagaagcctgaagagcggcgagaccagaaccatcagccacttccactacaccacctggcccgacttcggcgtgcccgagagccccgccagcttcctgaacttcctgttcaaggtgagagagagcggcagcctgaaccccgaccacggccccgccgtgatccactgcagcgccggcatcggcagaagcggcaccttcagcctggtggacacctgcctggtgctgatggagaagggcgacgacatcaacatcaagcaggtgctgctgaacatgagaaagtacagaatgggcctgatccagacccccgaccagctgagattcagctacatggccatcatcgagggcgccaagtgcatcaagggcgacagcagcatccagaagagatggaaggagctgagcaaggaggacctgagccccgccttcgaccacagccccaacaagatcatgaccgagaagtacaacggcaacagaatcggcctggaggaggagaagctgaccggcgacagatgcaccggcctgagcagcaagatgcaggacaccatggaggagaacagcgagagcgccctgagaaagagaatcagagaggacagaaaggccaccaccgcccagaaggtgcagcagatgaagcagagactgaacgagaacgagagaaagagaaagagacccagactgaccgacacctag

SEQ ID NO: 95445 - DNA, 2259 bp, Artificial Sequence
  Description of Artificial Sequence: Synthetic coding sequence
atggaccagagagagatcctgcagaagttcctggacgaggcccagagcaagaagatcaccaaggaggagttcgccaacgagttcctgaagctgaagagacagagcaccaagtacaaggccgacaagacctaccccaccaccgtggccgagaagcccaagaacatcaagaagaacagatacaaggacatcctgccctacgactacagcagagtggagctgagcctgatcaccagcgacgaggacagcagctacatcaacgccaacttcatcaagggcgtgtacggccccaaggcctacatcgccacccagggccccctgagcaccaccctgctggacttctggagaatgatctgggagtacagcgtgctgatcatcgtgatggcctgcatggagtacgagatgggcaagaagaagtgcgagagatactgggccgagcccggcgagatgcagctggagttcggccccttcagcgtgagctgcgaggccgagaagagaaagagcgactacatcatcagaaccctgaaggtgaagttcaacagcgagaccagaaccatctaccagttccactacaagaactggcccgaccacgacgtgcccagcagcatcgaccccatcctggagctgatctgggacgtgagatgctaccaggaggacgacagcgtgcccatctgcatccactgcagcgccggctgcggcagaaccggcgtgatctgcgccatcgactacacctggatgctgctgaaggacggcagccaggccaagcactgcatccccgagaagaaccacaccctgcaggccgacagctacagccccaacctgcccaagagcaccaccaaggccgccaagatgatgaaccagcagagaaccaagatggagatcaaggagagcagcagcttcgacttcagaaccagcgagatcagcgccaaggaggagctggtgctgcaccccgccaagagcagcaccagcttcgacttcctggagctgaactacagcttcgacaagaacgccgacaccaccatgaagtggcagaccaaggccttccccatcgtgggcgagcccctgcagaagcaccagagcctggacctgggcagcctgctgttcgagggctgcagcaacagcaagcccgtgaacgccgccggcagatacttcaacagcaaggtgcccatcaccagaaccaagagcacccccttcgagctgatccagcagagagagaccaaggaggtggacagcaaggagaacttcagctacctggagagccagccccacgacagctgcttcgtggagatgcaggcccagaaggtgatgcacgtgagcagcgccgagctgaactacagcctgccctacgacagcaagcaccagatcagaaacgccagcaacgtgaagcaccacgacagcagcgccctgggcgtgtacagctacatccccctggtggagaacccctacttcagcagctggccccccagcggcaccagcagcaagatgagcctggacctgcccgagaagcaggacggcaccgtgttccccagcagcctgctgcccaccagcagcaccagcctgttcagctactacaacagccacgacagcctgagcctgaacagccccaccaacatcagcagcctgctgaaccaggagagcgccgtgctggccaccgcccccagaatcgacgacgagatccccccccccctgcccgtgtggacccccgagagcttcatcgtggtggaggaggccggcgagttcagccccaacgtgcccaagagcctgagcagcgccgtgaaggtgaagatcggcaccagcctggagtggggcggcaccagcgagcccaagaagttcgacgacagcgtgatcctgagacccagcaagagcgtgaagctgagaagccccaagagcgagctgcaccaggacagaagcagcccccccccccccctgcccgagagaaccctggagagcttcttcctggccgacgaggactgcatgcaggcccagagcatcgagacctacagcaccagctaccccgacaccatggagaacagcaccagcagcaagcagaccctgaagacccccggcaagagcttcaccagaagcaagagcctgaagatcctgagaaacatgaagaagagcatctgcaacagctgcccccccaacaagcccgccgagagcgtgcagagcaacaacagcagcagcttcctgaacttcggcttcgccaacagattcagcaagcccaagggccccagaaaccccccccccacctggaacatctag

SEQ ID NO: 95446 - DNA, 5724 bp, Artificial Sequence
  Description of Artificial Sequence: Synthetic coding sequence
atgctgagccacggcgccggcctggccctgtggatcaccctgagcctgctgcagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccgacaaggtggccaacctggaggccaacaacaacggcagaatgagaagcctggtggtgagctggagcccccccgccggcgactgggagcagtacagaatcctgctgttcaacgacagcgtggtgctgctgaacatcaccgtgggcaaggaggagacccagtacgtgatggacgacaccggcctggtgcccggcagacagtacgaggtggaggtgatcgtggagagcggcaacctgaagaacagcgagagatgccagggcagaaccgtgcccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccagcagcgtgagcggcgtgaccgtgaacaacagcggcagaaacgactacctgagcgtgagctggctgctggcccccggcgacgtggacaactacgaggtgaccctgagccacgacggcaaggtggtgcagagcctggtgatcgccaagagcgtgagagagtgcagcttcagcagcctgacccccggcagactgtacaccgtgaccatcaccaccagaagcggcaagtacgagaaccacagcttcagccaggagagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaagagcatccccaagagcgagaacgagtgcgtgttcgtgcagctggtgcccggcagactgtacagcgtgaccgtgaccaccaagagcggccagtacgaggccaacgagcagggcaacggcagaaccatccccgagcccgtgaaggacctgaccctgagaaacagaagcaccgaggacctgcacgtgacctggagcggcgccaacggcgacgtggaccagtacgagatccagctgctgttcaacgacatgaaggtgttcccccccttccacctggtgaacaccgccaccgagtacagattcaccagcctgacccccggcagacagtacaagatcctggtgctgaccatcagcggcgacgtgcagcagagcgccttcatcgagggcttcaccgtgcccagcgccgtgaagaacatccacatcagccccaacggcgccaccgacagcctgaccgtgaactggacccccggcggcggcgacgtggacagctacaccgtgagcgccttcagacacagccagaaggtggacagccagaccatccccaagcacgtgttcgagcacaccttccacagactggaggccggcgagcagtaccagatcatgatcgccagcgtgagcggcagcctgaagaaccagatcaacgtggtgggcagaaccgtgcccgccgccgtgaccgacctgagaatcaccgagaacagcaccagacacctgagcttcagatggaccgccagcgagggcgagctgagctggtacaacatcttcctgtacaaccccgacggcaacctgcaggagagagcccaggtggaccccctggtgcagagcttcagcttccagaacctgctgcagggcagaatgtacaagatggtgatcgtgacccacagcggcgagctgagcaacgagagcttcatcttcggcagaaccgtgcccgccagcgtgagccacctgagaggcagcaacagaaacaccaccgacagcctgtggttcaactggagccccgccagcggcgacttcgacttctacgagctgatcctgtacaaccccaacggcaccaagaaggagaactggaaggacaaggacctgaccgagtggagattccagggcctggtgcccggcagaaagtacgtgctgtgggtggtgacccacagcggcgacctgagcaacaaggtgaccgccgagagcagaaccgcccccagcccccccagcctgatgagcttcgccgacatcgccaacaccagcctggccatcacctggaagggcccccccgactggaccgactacaacgacttcgagctgcagtggctgcccagagacgccctgaccgtgttcaacccctacaacaacagaaagagcgagggcagaatcgtgtacggcctgagacccggcagaagctaccagttcaacgtgaagaccgtgagcggcgacagctggaagacctacagcaagcccatcttcggcagcgtgagaaccaagcccgacaagatccagaacctgcactgcagaccccagaacagcaccgccatcgcctgcagctggatcccccccgacagcgacttcgacggctacagcatcgagtgcagaaagatggacacccaggaggtggagttcagcagaaagctggagaaggagaagagcctgctgaacatcatgatgctggtgccccacaagagatacctggtgagcatcaaggtgcagagcgccggcatgaccagcgaggtggtggaggacagcaccatcaccatgatcgacagacccccccccccccccccccacatcagagtgaacgagaaggacgtgctgatcagcaagagcagcatcaacttcaccgtgaactgcagctggttcagcgacaccaacggcgccgtgaagtacttcaccgtggtggtgagagaggccgacggcagcgacgagctgaagcccgagcagcagcaccccctgcccagctacctggagtacagacacaacgccagcatcagagtgtaccagaccaactacttcgccagcaagtgcgccgagaaccccaacagcaacagcaagagcttcaacatcaagctgggcgccgagatggagagcctgggcggcaagtgcgaccccacccagcagaagttctgcgacggccccctgaagccccacaccgcctacagaatcagcatcagagccttcacccagctgttcgacgaggacctgaaggagttcaccaagcccctgtacagcgacaccttcttcagcctgcccatcaccaccgagagcgagcccctgttcggcgccatcgagggcgtgagcgccggcctgttcctgatcggcatgctggtggccgtggtggccctgctgatctgcagacagaaggtgagccacggcagagagagacccagcgccagactgagcatcagaagagacagacccctgagcgtgcacctgaacctgggccagaagggcaacagaaagaccagctgccccatcaagatcaaccagttcgagggccacttcatgaagctgcaggccgacagcaactacctgctgagcaaggagtacgaggagctgaaggacgtgggcagaaaccagagctgcgacatcgccctgctgcccgagaacagaggcaagaacagatacaacaacatcctgccctacgacgccaccagagtgaagctgagcaacgtggacgacgacccctgcagcgactacatcaacgccagctacatccccggcaacaacttcagaagagagtacatcgtgacccagggccccctgcccggcaccaaggacgacttctggaagatggtgtgggagcagaacgtgcacaacatcgtgatggtgacccagtgcgtggagaagggcagagtgaagtgcgaccactactggcccgccgaccaggacagcctgtactacggcgacctgatcctgcagatgctgagcgagagcgtgctgcccgagtggaccatcagagagttcaagatctgcggcgaggagcagctggacgcccacagactgatcagacacttccactacaccgtgtggcccgaccacggcgtgcccgagaccacccagagcctgatccagttcgtgagaaccgtgagagactacatcaacagaagccccggcgccggccccaccgtggtgcactgcagcgccggcgtgggcagaaccggcaccttcatcgccctggacagaatcctgcagcagctggacagcaaggacagcgtggacatctacggcgccgtgcacgacctgagactgcacagagtgcacatggtgcagaccgagtgccagtacgtgtacctgcaccagtgcgtgagagacgtgctgagagccagaaagctgagaagcgagcaggagaaccccctgttccccatctacgagaacgtgaaccccgagtaccacagagaccccgtgtacagcagacactag

SEQ ID NO: 95447 - DNA, 4518 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgagagcatcggcgccctgcagatcgagcagagcgaggagagcgaccagggcaagtacgagtgcgtggccaccaacagcgccggcaccagatacagcgcccccgccaacctgtacgtgagagtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcagcgacgacagcggctaccccggcaacctgcacagcagcagcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95448 - DNA, 4398 bp, Artificial Sequence
  Description of Artificial Sequence: Synthetic coding sequence
atgagaggcctgggcacctgcctggccaccctggccggcctgctgctgaccgccgccggcgagaccttcagcggcggctgcctgttcgacgagccctacagcacctgcggctacagccagagcgagggcgacgacttcaactgggagcaggtgaacaccctgaccaagcccaccagcgacccctggatgcccagcggcagcttcatgctggtgaacgccagcggcagacccgagggccagagagcccacctgctgctgccccagctgaaggagaacgacacccactgcatcgacttccactacttcgtgagcagcaagagcaacagcccccccggcctgctgaacgtgtacgtgaaggtgaacaacggccccctgggcaaccccatctggaacatcagcggcgaccccaccagaacctggaacagagccgagctggccatcagcaccttctggcccaacttctaccaggtgatcttcgaggtgatcaccagcggccaccagggctacctggccatcgacgaggtgaaggtgctgggccacccctgcaccagaaccccccacttcctgagaatccagaacgtggaggtgaacgccggccagttcgccaccttccagtgcagcgccatcggcagaaccgtggccggcgacagactgtggctgcagggcatcgacgtgagagacgcccccctgaaggagatcaaggtgaccagcagcagaagattcatcgccagcttcaacgtggtgaacaccaccaagagagacgccggcaagtacagatgcatgatcagaaccgagggcggcgtgggcatcagcaactacgccgagctggtggtgaaggagccccccgtgcccatcgcccccccccagctggccagcgtgggcgccacctacctgtggatccagctgaacgccaacagcatcaacggcgacggccccatcgtggccagagaggtggagtactgcaccgccagcggcagctggaacgacagacagcccgtggacagcaccagctacaagatcggccacctggaccccgacaccgagtacgagatcagcgtgctgctgaccagacccggcgagggcggcaccggcagccccggccccgccctgagaaccagaaccaagtgcgccgaccccatgagaggccccagaaagctggaggtggtggaggtgaagagcagacagatcaccatcagatgggagcccttcggctacaacgtgaccagatgccacagctacaacctgaccgtgcactactgctaccaggtgggcggccaggagcaggtgagagaggaggtgagctgggacaccgagaacagccacccccagcacaccatcaccaacctgagcccctacaccaacgtgagcgtgaagctgatcctgatgaaccccgagggcagaaaggagagccaggagctgatcgtgcagaccgacgaggacctgcccggcgccgtgcccaccgagagcatccagggcagcaccttcgaggagaagatcttcctgcagtggagagagcccacccagacctacggcgtgatcaccctgtacgagatcacctacaaggccgtgagcagcttcgaccccgagatcgacctgagcaaccagagcggcagagtgagcaagctgggcaacgagacccacttcctgttcttcggcctgtaccccggcaccacctacagcttcaccatcagagccagcaccgccaagggcttcggcccccccgccaccaaccagttcaccaccaagatcagcgcccccagcatgcccgcctacgagctggagacccccctgaaccagaccgacaacaccgtgaccgtgatgctgaagcccgcccacagcagaggcgcccccgtgagcgtgtaccagatcgtggtggaggaggagagacccagaagaaccaagaagaccaccgagatcctgaagtgctaccccgtgcccatccacttccagaacgccagcctgctgaacagccagtactacttcgccgccgagttccccgccgacagcctgcaggccgcccagcccttcaccatcggcgacaacaagacctacaacggctactggaacacccccctgctgccctacaagagctacagaatctacttccaggccgccagcagagccaacggcgagaccaagatcgactgcgtgcaggtggccaccaagggcgccgccacccccaagcccgtgcccgagcccgagaagcagaccgaccacaccgtgaagatcgccggcgtgatcgccggcatcctgctgttcgtgatcatcttcctgggcgtggtgctggtgatgaagaagagaaagctggccaagaagagaaaggagaccatgagcagcaccagacaggagatgaccgtgatggtgaacagcatggacaagagctacgccgagcagggcaccaactgcgacgaggccttcagcttcatggacacccacaacctgaacggcagaagcgtgagcagccccagcagcttcaccatgaagaccaacaccctgagcaccagcgtgcccaacagctactaccccgaccccttcgtgcccaccgccatcctggtgcccatcaacgacgagacccacaccatggccagcgacaccagcagcctggtgcagagccacacctacaagaagagagagcccgccgacgtgccctaccagaccggccagctgcaccccgccatcagagtggccgacctgctgcagcacatcacccagatgaagtgcgccgagggctacggcttcaaggaggagtacgagagcttcttcgagggccagagcgccccctgggacagcgccaagaaggacgagaacagaatgaagaacagatacggcaacatcatcgcctacgaccacagcagagtgagactgcagaccatcgagggcgacaccaacagcgactacatcaacggcaactacatcgacggctaccacagacccaaccactacatcgccacccagggccccatgcaggagaccatctacgacttctggagaatggtgtggcacgagaacaccgccagcatcatcatggtgaccaacctggtggaggtgggcagagtgaagtgctgcaagtactggcccgacgacaccgagatctacaaggacatcaaggtgaccctgatcgagaccgagctgctggccgagtacgtgatcagaaccttcgccgtggagaagagaggcgtgcacgagatcagagagatcagacagttccacttcaccggctggcccgaccacggcgtgccctaccacgccaccggcctgctgggcttcgtgagacaggtgaagagcaagagcccccccagcgccggccccctggtggtgcactgcagcgccggcgccggcagaaccggctgcttcatcgtgatcgacatcatgctggacatggccgagagagagggcgtggtggacatctacaactgcgtgagagagctgagaagcagaagagtgaacatggtgcagaccgaggagcagtacgtgttcatccacgacgccatcctggaggcctgcctgtgcggcgacaccagcgtgcccgccagccaggtgagaagcctgtactacgacatgaacaagctggacccccagaccaacagcagccagatcaaggaggagttcagaaccctgaacatggtgacccccaccctgagagtggaggactgcagcatcgccctgctgcccagaaaccacgagaagaacagatgcatggacatcctgccccccgacagatgcctgcccttcctgatcaccatcgacggcgagagcagcaactacatcaacgccgccctgatggacagctacaagcagcccagcgccttcatcgtgacccagcaccccctgcccaacaccgtgaaggacttctggagactggtgctggactaccactgcaccagcgtggtgatgctgaacgacgtggaccccgcccagctgtgcccccagtactggcccgagaacggcgtgcacagacacggccccatccaggtggagttcgtgagcgccgacctggaggaggacatcatcagcagaatcttcagaatctacaacgccgccagaccccaggacggctacagaatggtgcagcagttccagttcctgggctggcccatgtacagagacacccccgtgagcaagagaagcttcctgaagctgatcagacaggtggacaagtggcaggaggagtacaacggcggcgagggcagaaccgtggtgcactgcctgaacggcggcggcagaagcggcaccttctgcgccatcagcatcgtgtgcgagatgctgagacaccagagaaccgtggacgtgttccacgccgtgaagaccctgagaaacaacaagcccaacatggtggacctgctggaccagtacaagttctgctacgaggtggccctggagtacctgaacagcggctag

SEQ ID NO: 95449 - DNA, 4323 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacatcagaatcaacagagagggctaccacagaagcaaccacttcatcgccacccagggccccaagcccgagatggtgtacgacttctggagaatggtgtggcaggagcactgcagcagcatcgtgatgatcaccaagctggtggaggtgggcagagtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagagagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95450 - DNA, 4347 bp, Artificial Sequence
  Description of Artificial Sequence: Synthetic coding sequence
atgagaatcctgaagagattcctggcctgcatccagctgctgtgcgtgtgcagactggactgggccaacggctactacagacagcagagaaagctggtggaggagatcggctggagctacaccggcgccctgaaccagaagaactggggcaagaagtaccccacctgcaacagccccaagcagagccccatcaacatcgacgaggacctgacccaggtgaacgtgaacctgaagaagctgaagttccagggctgggacaagaccagcctggagaacaccttcatccacaacaccggcaagaccgtggagatcaacctgaccaacgactacagagtgagcggcggcgtgagcgagatggtgttcaaggccagcaagatcaccttccactggggcaagtgcaacatgagcagcgacggcagcgagcacagcctggagggccagaagttccccctggagatgcagatctactgcttcgacgccgacagattcagcagcttcgaggaggccgtgaagggcaagggcaagctgagagccctgagcatcctgttcgaggtgggcaccgaggagaacctggacttcaaggccatcatcgacggcgtggagagcgtgagcagattcggcaagcaggccgccctggaccccttcatcctgctgaacctgctgcccaacagcaccgacaagtactacatctacaacggcagcctgaccagccccccctgcaccgacaccgtggactggatcgtgttcaaggacaccgtgagcatcagcgagagccagctggccgtgttctgcgaggtgctgaccatgcagcagagcggctacgtgatgctgatggactacctgcagaacaacttcagagagcagcagtacaagttcagcagacaggtgttcagcagctacaccggcaaggaggagatccacgaggccgtgtgcagcagcgagcccgagaacgtgcaggccgaccccgagaactacaccagcctgctggtgacctgggagagacccagagtggtgtacgacaccatgatcgagaagttcgccgtgctgtaccagcagctggacggcgaggaccagaccaagcacgagttcctgaccgacggctaccaggacctgggcgccatcctgaacaacctgctgcccaacatgagctacgtgctgcagatcgtggccatctgcaccaacggcctgtacggcaagtacagcgaccagctgatcgtggacatgcccaccgacaaccccgagctggacctgttccccgagctgatcggcaccgaggagatcatcaaggaggaggaggagggcaaggacatcgaggagggcgccatcgtgaaccccggcagagacagcgccaccaaccagatcagaaagaaggagccccagatcagcaccaccacccactacaacagaatcggcaccaagtacaacgaggccaagaccaacagaagccccaccagaggcagcgagttcagcggcaagggcgacgtgcccaacaccagcctgaacagcaccagccagcccgtgaccaagctggccaccgagaaggacatcagcctgaccagccagaccgtgaccgagctgcccccccacaccgtggagggcaccagcgccagcctgaacgacggcagcaagaccgtgctgagaagcccccacatgaacctgagcggcaccgccgagagcctgaacaccgtgagcatcaccgagtacgaggaggagagcctgctgaccagcttcaagctggacaccggcgccgaggacagcagcggcagcagccccgccaccagcgccatccccttcatcagcgagaacatcagccagggctacatcttcagcagcgagaaccccgagaccatcacctacgacgtgctgatccccgagagcgccagaaacgccagcgaggacagcaccagcagcggcagcgaggagagcctgaaggaccccagcatggagggcaacgtgtggttccccagcagcaccgacatcaccgcccagcccgacgtgggcagcggcagagagagcttcctgcagaccaactacaccgagatcagagtggacgagagcgagaagaccaccaagagcttcagcgccggccccgtgatgagccagggccccagcgtgaccgacctggagatgccccactacagcaccttcgcctacttccccaccgaggtgaccccccacgccttcacccccagcagcagacagcaggacctggtgagcaccgtgaacgtggtgtacagccagaccacccagcccgtgtacaacgaggccagcaacagcagccacgagagcagaatcggcctggccgagggcctggagagcgagaagaaggccgtgatccccctggtgatcgtgagcgccctgaccttcatctgcctggtggtgctggtgggcatcctgatctactggagaaagtgcttccagaccgcccacttctacctggaggacagcaccagccccagagtgatcagcaccccccccacccccatcttccccatcagcgacgacgtgggcgccatccccatcaagcacttccccaagcacgtggccgacctgcacgccagcagcggcttcaccgaggagttcgaggaggtgcagagctgcaccgtggacctgggcatcaccgccgacagcagcaaccaccccgacaacaagcacaagaacagatacatcaacatcgtggcctacgaccacagcagagtgaagctggcccagctggccgagaaggacggcaagctgaccgactacatcaacgccaactacgtggacggctacaacagacccaaggcctacatcgccgcccagggccccctgaagagcaccgccgaggacttctggagaatgatctgggagcacaacgtggaggtgatcgtgatgatcaccaacctggtggagaagggcagaagaaagtgcgaccagtactggcccgccgacggcagcgaggagtacggcaacttcctggtgacccagaagagcgtgcaggtgctggcctactacaccgtgagaaacttcaccctgagaaacaccaagatcaagaagggcagccagaagggcagacccagcggcagagtggtgacccagtaccactacacccagtggcccgacatgggcgtgcccgagtacagcctgcccgtgctgaccttcgtgagaaaggccgcctacgccaagagacacgccgtgggccccgtggtggtgcactgcagcgccggcgtgggcagaaccggcacctacatcgtgctggacagcatgctgcagcagatccagcacgagggcaccgtgaacatcttcggcttcctgaagcacatcagaagccagagaaactacctggtgcagaccgaggagcagtacgtgttcatccacgacaccctggtggaggccatcctgagcaaggagaccgaggtgctggacagccacatccacgcctacgtgaacgccctgctgatccccggccccgccggcaagaccaagctggagaagcagttccagctgctgagccagagcaacatccagcagagcgactacagcgccgccctgaagcagtgcaacagagagaagaacagaaccagcagcatcatccccgtggagagaagcagagtgggcatcagcagcctgagcggcgagggcaccgactacatcaacgccagctacatcatgggctactaccagagcaacgagttcatcatcacccagcaccccctgctgcacaccatcaaggacttctggagaatgatctgggaccacaacgcccagctggtggtgatgatccccgacggccagaacatggccgaggacgagttcgtgtactggcccaacaaggacgagcccatcaactgcgagagcttcaaggtgaccctgatggccgaggagcacaagtgcctgagcaacgaggagaagctgatcatccaggacttcatcctggaggccacccaggacgactacgtgctggaggtgagacacttccagtgccccaagtggcccaaccccgacagccccatcagcaagaccttcgagctgatcagcgtgatcaaggaggaggccgccaacagagacggccccatgatcgtgcacgacgagcacggcggcgtgaccgccggcaccttctgcgccctgaccaccctgatgcaccagctggagaaggagaacagcgtggacgtgtaccaggtggccaagatgatcaacctgatgagacccggcgtgttcgccgacatcgagcagtaccagttcctgtacaaggtgatcctgagcctggtgagcaccagacaggaggagaaccccagcaccagcctggacagcaacggcgccgccctgcccgacggcaacatcgccgagagcctggagagcctggtgtag

SEQ ID NO: 95451 - DNA, 504 bp, Artificial Sequence
  Description of Artificial Sequence: Synthetic coding sequence
atgaacagacccgcccccgtggagatcagctacgagaacatgagattcctgatcacccacaaccccaccaacgccaccctgaacaagttcaccgaggagctgaagaagtacggcgtgaccaccctggtgagagtgtgcgacgccacctacgacaaggcccccgtggagaaggagggcatccacgtgctggactggcccttcgacgacggcgcccccccccccaaccagatcgtggacgactggctgaacctgctgaagaccaagttcagagaggagcccggctgctgcgtggccgtgcactgcgtggccggcctgggcagagcccccgtgctggtggccctggccctgatcgagtgcggcatgaagtacgaggacgccgtgcagttcatcagacagaagagaagaggcgccttcaacagcaagcagctgctgtacctggagaagtacagacccaagatgagactgagattcagagacaccaacggccactgctgcgtgcagtag

SEQ ID NO: 95452 - DNA, 249 bp, Artificial Sequence
  Description of Artificial Sequence: Synthetic coding sequence
atgaacagacccgcccccgtggagatcagctacgagaacatgagattcctgatcacccacaaccccaccaacgccaccctgaacaagttcaccgaggagctgaagaagtacggcgtgaccaccctggtgagagtgtgcgacgccacctacgacaaggcccccgtggagaaggagggcatccacgtgctgaagaagaagggcagcgtgcagttccagaccgccgccctgttcggcgagatccccacctag

SEQ ID NO: 95453 - DNA, 411 bp, Artificial Sequence
  Description of Artificial Sequence: Synthetic coding sequence
atgaacagacccgcccccgtggagatcagctacgagaacatgagattcctgatcacccacaaccccaccaacgccaccctgaacaagttcaccgaggactggcccttcgacgacggcgcccccccccccaaccagatcgtggacgactggctgaacctgctgaagaccaagttcagagaggagcccggctgctgcgtggccgtgcactgcgtggccggcctgggcagagcccccgtgctggtggccctggccctgatcgagtgcggcatgaagtacgaggacgccgtgcagttcatcagacagaagagaagaggcgccttcaacagcaagcagctgctgtacctggagaagtacagacccaagatgagactgagattcagagacaccaacggccactgctgcgtgcagtag

SEQ ID NO: 95454 - DNA, 192 bp, Artificial Sequence
  Description of Artificial Sequence: Synthetic coding sequence
atgaacagacccgcccccgtggagatcagctacgagaacatgagattcctgatcacccacaaccccaccaacgccaccctgaacaagttcaccgaggagctgaagaagtacggcgtgaccaccctggtgagagtgtgcgacgccacctacgacaaggcccccgtggagaaggagggcatccacgtgctgtag

SEQ ID NO: 95455 - DNA, 69 bp, Artificial Sequence
  Description of Artificial Sequence: Synthetic coding sequence
atgaacagacccgcccccgtggagatcagctacgagaacatgagattcctgatcacccacaacccctag

SEQ ID NO: 95456 - DNA, 522 bp, Artificial Sequence
  Description of Artificial Sequence: Synthetic coding sequence
atggccagaatgaacagacccgcccccgtggaggtgagctacaagcacatgagattcctgatcacccacaaccccaccaacgccaccctgagcaccttcatcgaggacctgaagaagtacggcgccaccaccgtggtgagagtgtgcgaggtgacctacgacaagacccccctggagaaggacggcatcaccgtggtggactggcccttcgacgacggcgcccccccccccggcaaggtggtggaggactggctgagcctggtgaaggccaagttctgcgaggcccccggcagctgcgtggccgtgcactgcgtggccggcctgggcagagcccccgtgctggtggccctggccctgatcgagagcggcatgaagtacgaggacgccatccagttcatcagacagaagagaagaggcgccatcaacagcaagcagctgacctacctggagaagtacagacccaagcagagactgagattcaaggacccccacacccacaagaccagatgctgcgtgatgtag

SEQ ID NO: 95457 - DNA, 447 bp, Artificial Sequence
  Description of Artificial Sequence: Synthetic coding sequence
atggccagaatgaacagacccgcccccgtggaggtgagctacaagcacatgagattcctgatcacccacaaccccaccaacgccaccctgagcaccttcatcgaggacctgaagaagtacggcgccaccaccgtggtgagagtgtgcgaggtgacctacgacaagacccccctggagaaggacggcatcaccgtggtggactggcccttcgacgacggcgcccccccccccggcaaggtggtggaggactggctgagcctggtgaaggccaagttctgcgaggcccccggcagctgcgtggccgtgcactgcgtggccggcctgggcagaaagagaagaggcgccatcaacagcaagcagctgacctacctggagaagtacagacccaagcagagactgagattcaaggacccccacacccacaagaccagatgctgcgtgatgtag

SEQ ID NO: 95458 - DNA, 447 bp, Artificial Sequence; identical to SEQ ID NO: 95457
  Description of Artificial Sequence: Synthetic coding sequence

SEQ ID NO: 95459 - DNA, 522 bp, Artificial Sequence; identical to SEQ ID NO: 95456
  Description of Artificial Sequence: Synthetic coding sequence

SEQ ID NO: 95460 - DNA, 213 bp, Artificial Sequence
  Description of Artificial Sequence: Synthetic coding sequence
atggccagaatgaacagacccgcccccgtggaggtgagctacaagcacatgagattcctgatcacccacaaccccaccaacgccaccctgagcaccttcatcgaggacctgaagaagtacggcgccaccaccgtggtgagagtgtgcgaggtgacctacgacaagacccccctggagaaggacggcatcaccgtggtggactggcccttctag

SEQ ID NO: 95461 - DNA, 2343 bp, Artificial Sequence
  Description of Artificial Sequence: Synthetic coding sequence
atggagcaggtggagatcctgagaaagttcatccagagagtgcaggccatgaagagccccgaccacaacggcgaggacaacttcgccagagacttcatgagactgagaagactgagcaccaagtacagaaccgagaagatctaccccaccgccaccggcgagaaggaggagaacgtgaagaagaacagatacaaggacatcctgcccttcgaccacagcagagtgaagctgaccctgaagacccccagccaggacagcgactacatcaacgccaacttcatcaagggcgtgtacggccccaaggcctacgtggccacccagggccccctggccaacaccgtgatcgacttctggagaatgatctgggagtacaacgtggtgatcatcgtgatggcctgcagagagttcgagatgggcagaaagaagtgcgagagatactggcccctgtacggcgaggaccccatcaccttcgcccccttcaagatcagctgcgaggacgagcaggccagaaccgactacttcatcagaaccctgctgctggagttccagaacgagagcagaagactgtaccagttccactacgtgaactggcccgaccacgacgtgcccagcagcttcgacagcatcctggacatgatcagcctgatgagaaagtaccaggagcacgaggacgtgcccatctgcatccactgcagcgccggctgcggcagaaccggcgccatctgcgccatcgactacacctggaacctgctgaaggccggcaagatccccgaggagttcaacgtgttcaacctgatccaggagatgagaacccagagacacagcgccgtgcagaccaaggagcagtacgagctggtgcacagagccatcgcccagctgttcgagaagcagctgcagctgtacgagatccacggcgcccagaagatcgccgacggcgtgaacgagatcaacaccgagaacatggtgagcagcatcgagcccgagaagcaggacagccccccccccaagccccccagaaccagaagctgcctggtggagggcgacgccaaggaggagatcctgcagccccccgagccccaccccgtgccccccatcctgacccccagcccccccagcgccttccccaccgtgaccaccgtgtggcaggacaacgacagataccaccccaagcccgtgctgcacatggtgagcagcgagcagcacagcgccgacctgaacagaaactacagcaagagcaccgagctgcccggcaagaacgagagcaccatcgagcagatcgacaagaagctggagagaaacctgagcttcgagatcaagaaggtgcccctgcaggagggccccaagagcttcgacggcaacaccctgctgaacagaggccacgccatcaagatcaagagcgccagcccctgcatcgccgacaagatcagcaagccccaggagctgagcagcgacctgaacgtgggcgacaccagccagaacagctgcgtggactgcagcgtgacccagagcaacaaggtgagcgtgaccccccccgaggagagccagaacagcgacaccccccccagacccgacagactgcccctggacgagaagggccacgtgacctggagcttccacggccccgagaacgccatccccatccccgacctgagcgagggcaacagcagcgacatcaactaccagaccagaaagaccgtgagcctgacccccagccccaccacccaggtggagacccccgacctggtggaccacgacaacaccagccccctgttcagaacccccctgagcttcaccaaccccctgcacagcgacgacagcgacagcgacgagagaaacagcgacggcgccgtgacccagaacaagaccaacatcagcaccgccagcgccaccgtgagcgccgccaccagcaccgagagcatcagcaccagaaaggtgctgcccatgagcatcgccagacacaacatcgccggcaccacccacagcggcgccgagaaggacgtggacgtgagcgaggacagccccccccccctgcccgagagaacccccgagagcttcgtgctggccagcgagcacaacacccccgtgagaagcgagtggagcgagctgcagagccaggagagaagcgagcagaagaagagcgagggcctgatcaccagcgagaacgagaagtgcgaccaccccgccggcggcatccactacgagatgtgcatcgagtgcccccccaccttcagcgacaagagagagcagatcagcgagaaccccaccgaggccaccgacatcggcttcggcaacagatgcggcaagcccaagggccccagagacccccccagcgagtggacctag

SEQ ID NO: 95462 - DNA, 1986 bp, Artificial Sequence
  Description of Artificial Sequence: Synthetic coding sequence
atgatctgggagtacaacgtggtgatcatcgtgatggcctgcagagagttcgagatgggcagaaagaagtgcgagagatactggcccctgtacggcgaggaccccatcaccttcgcccccttcaagatcagctgcgaggacgagcaggccagaaccgactacttcatcagaaccctgctgctggagttccagaacgagagcagaagactgtaccagttccactacgtgaactggcccgaccacgacgtgcccagcagcttcgacagcatcctggacatgatcagcctgatgagaaagtaccaggagcacgaggacgtgcccatctgcatccactgcagcgccggctgcggcagaaccggcgccatctgcgccatcgactacacctggaacctgctgaaggccggcaagatccccgaggagttcaacgtgttcaacctgatccaggagatgagaacccagagacacagcgccgtgcagaccaaggagcagtacgagctggtgcacagagccatcgcccagctgttcgagaagcagctgcagctgtacgagatccacggcgcccagaagatcgccgacggcgtgaacgagatcaacaccgagaacatggtgagcagcatcgagcccgagaagcaggacagccccccccccaagccccccagaaccagaagctgcctggtggagggcgacgccaaggaggagatcctgcagccccccgagccccaccccgtgccccccatcctgacccccagcccccccagcgccttccccaccgtgaccaccgtgtggcaggacaacgacagataccaccccaagcccgtgctgcacatggtgagcagcgagcagcacagcgccgacctgaacagaaactacagcaagagcaccgagctgcccggcaagaacgagagcaccatcgagcagatcgacaagaagctggagagaaacctgagcttcgagatcaagaaggtgcccctgcaggagggccccaagagcttcgacggcaacaccctgctgaacagaggccacgccatcaagatcaagagcgccagcccctgcatcgccgacaagatcagcaagccccaggagctgagcagcgacctgaacgtgggcgacaccagccagaacagctgcgtggactgcagcgtgacccagagcaacaaggtgagcgtgaccccccccgaggagagccagaacagcgacaccccccccagacccgacagactgcccctggacgagaagggccacgtgacctggagcttccacggccccgagaacgccatccccatccccgacctgagcgagggcaacagcagcgacatcaactaccagaccagaaagaccgtgagcctgacccccagccccaccacccaggtggagacccccgacctggtggaccacgacaacaccagccccctgttcagaacccccctgagcttcaccaaccccctgcacagcgacgacagcgacagcgacgagagaaacagcgacggcgccgtgacccagaacaagaccaacatcagcaccgccagcgccaccgtgagcgccgccaccagcaccgagagcatcagcaccagaaaggtgctgcccatgagcatcgccagacacaacatcgccggcaccacccacagcggcgccgagaaggacgtggacgtgagcgaggacagccccccccccctgcccgagagaacccccgagagcttcgtgctggccagcgagcacaacacccccgtgagaagcgagtggagcgagctgcagagccaggagagaagcgagcagaagaagagcgagggcctgatcaccagcgagaacgagaagtgcgaccaccccgccggcggcatccactacgagatgtgcatcgagtgcccccccaccttcagcgacaagagagagcagatcagcgagaaccccaccgaggccaccgacatcggcttcggcaacagatgcggcaagcccaagggccccagagacccccccagcgagtggacctag

SEQ ID NO: 95463 - DNA, 1632 bp, Artificial Sequence
  Description of Artificial Sequence: Synthetic coding sequence
atgatctgggagtacaacgtggtgatcatcgtgatggcctgcagagagttcgagatgggcagaaagaagtgcgagagatactggcccctgtacggcgaggaccccatcaccttcgcccccttcaagatcagctgcgaggacgagcaggccagaaccgactacttcatcagaaccctgctgctggagttccagaacgagagcagaagactgtaccagttccactacgtgaactggcccgaccacgacgtgcccagcagcttcgacagcatcctggacatgatcagcctgatgagaaagtaccaggagcacgaggacgtgcccatctgcatccactgcagcgccggctgcggcagaaccggcgccatctgcgccatcgactacacctggaacctgctgaaggccggcaagatccccgaggagttcaacgtgttcaacctgatccaggagatgagaacccagagacacagcgccgtgcagaccaaggagcagtacgagctggtgcacagagccatcgcccagctgttcgagaagcagctgcagctgtacgagatccacggcgcccagaagatcgccgacggcgtgaacgagatcaacaccgagaacatggtgagcagcatcgagcccgagaagcaggacagccccccccccaagccccccagaaccagaagctgcctggtggagggcgacgccaaggaggagatcctgcagccccccgagccccaccccgtgccccccatcctgacccccagcccccccagcgccttccccaccgtgaccaccgtgtggcaggacaacgacagataccaccccaagcccgtgctgcacatggtgagcagcgagcagcacagcgccgacctgaacagaaactacagcaagagcaccgagctgcccggcaagaacgagagcaccatcgagcagatcgacaagaagctggagagaaacctgagcttcgagatcaagaaggtgcccctgcaggagggccccaagagcttcgacggcaacaccctgctgaacagaggccacgccatcaagatcaagagcgccagcccctgcatcgccgacaagatcagcaagccccaggagctgagcagcgacctgaacgtgggcgacaccagccagaacagctgcgtggactgcagcgtgacccagagcaacaaggtgagcgtgaccccccccgaggagagccagaacagcgacaccccccccagacccgacagactgcccctggacgagaagggccacgtgacctggagcttccacggccccgagaacgccatccccatccccgacctgagcgagggcaacagcagcgacatcaactaccagaccagaaagaccgtgagcctgacccccagccccaccacccaggtggagacccccgacctggtggaccacgacaacaccagccccctgttcagaacccccctgagcttcaccaaccccctgcacagcgacgacagcgacagcgacgagagaaacagcgacggcgccgtgacccagaacaagaccaacatcagcaccgccagcgccaccgtgagcgccgccaccagcaccgagagcatcagcaccagaaaggtgctgcccatgagcatcgccagacacaacagcagaaacaacaccttcagatgctag

SEQ ID NO: 95464 - DNA, 6885 bp, Artificial Sequence
  Description of Artificial Sequence: Synthetic coding sequence
atgcacgtgagcctggccgaggccctggaggtgagaggcggccccctgcaggaggaggagatctgggccgtgctgaaccagagcgccgagagcctgcaggagctgttcagaaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgatctacgccagagtgagcgtgagaaccgtgctggacgcctgcagcgcccacatcagaaacagcaactgcgcccccagcttcagctacgtgaagcacctggtgaagctggtgctgggcaacctgagcggcaccgaccagctgagctgcaacagcgagcagaagcccgacagaagccaggccatcagagacagactgagaggcaagggcctgcccaccggcagaagcagcaccagcgacgtgctggacatccagaagccccccctgagccaccagaccttcctgaacaagggcctgagcaagagcatgggcttcctgagcatcaaggacacccaggacgagaactacttcaaggacatcctgagcgacaacagcggcagagaggacagcgagaacaccttcagcccctaccagttcaagaccagcggccccgagaagaagcccatccccggcatcgacgtgctgagcaagaagaagatctgggccagcagcatggacctgctgtgcaccgccgacagagacttcagcagcggcgagaccgccacctacagaagatgccaccccgaggccgtgaccgtgagaaccagcaccacccccagaaagaaggaggccagatacagcgacggcagcatcgccctggacatcttcggcccccagaagatggaccccatctaccacaccagagagctgcccaccagcagcgccatcagcagcgccctggacagaatcagagagagacagaagaagctgcaggtgctgagagaggccatgaacgtggaggagcccgtgagaagatacaagacctaccacggcgacgtgttcagcaccagcagcgagagccccagcatcatcagcagcgagagcgacttcagacaggtgagaagaagcgaggccagcaagagattcgagagcagcagcggcctgcccggcgtggacgagaccctgagccagggccagagccagagacccagcagacagtacgagacccccttcgagggcaacctgatcaaccaggagatcatgctgaagagacaggaggaggagctgatgcagctgcaggccaagatggccctgagacagagcagactgagcctgtaccccggcgacaccatcaaggccagcatgctggacatcaccagagaccccctgagagagatcgccctggagaccgccatgacccagagaaagctgagaaacttcttcggccccgagttcgtgaagatgaccatcgagcccttcatcagcctggacctgcccagaagcatcctgaccaagaagggcaagaacgaggacaacagaagaaaggtgaacatcatgctgctgaacggccagagactggagctgacctgcgacaccaagaccatctgcaaggacgtgttcgacatggtggtggcccacatcggcctggtggagcaccacctgttcgccctggccaccctgaaggacaacgagtacttcttcgtggaccccgacctgaagctgaccaaggtggcccccgagggctggaaggaggagcccaagaagaagaccaaggccaccgtgaacttcaccctgttcttcagaatcaagttcttcatggacgacgtgagcctgatccagcacaccctgacctgccaccagtactacctgcagctgagaaaggacatcctggaggagagaatgcactgcgacgacgagaccagcctgctgctggccagcctggccctgcaggccgagtacggcgactaccagcccgaggtgcacggcgtgagctacttcagaatggagcactacctgcccgccagagtgatggagaagctggacctgagctacatcaaggaggagctgcccaagctgcacaacacctacgtgggcgccagcgagaaggagaccgagctggagttcctgaaggtgtgccagagactgaccgagtacggcgtgcacttccacagagtgcaccccgagaagaagagccagaccggcatcctgctgggcgtgtgcagcaagggcgtgctggtgttcgaggtgcacaacggcgtgagaaccctggtgctgagattcccctggagagagaccaagaagatcagcttcagcaagaagaagatcaccctgcagaacaccagcgacggcatcaagcacggcttccagaccgacaacagcaagatctgccagtacctgctgcacctgtgcagctaccagcacaagttccagctgcagatgagagccagacagagcaaccaggacgcccaggacatcgacgtgctgcacaagagatggagcatcgtgagcagccccgagagagagatcaccctggtgaacctgaagaaggacgccaagtacggcctgggcttccagatcatcggcggcgagaagatgggcagactggacctgggcatcttcatcagcagcgtggcccccggcggccccgccgacctggacggctgcctgaagcccggcgacagactgatcagcgtgaacagcgtgagcctggagggcgtgagccaccacgccgccatcgagatcctgcagaacgcccccgaggacgtgaccctggtgatcagccagcccaaggagaagatcagcaaggtgcccagcacccccgtgcacctgaccaacgagatgaagaactacatgaagaagagcagctacatgcaggacagcgccatcgacagcagcagcaaggaccaccactggagcagaggcaccctgagacacatcagcgagaacagcttcggccccagcggcggcctgagagagggcagcctgagcagccaggacagcagaaccgagagcgccagcctgagccagagccaggtgaacggcttcttcgccagccacctgggcgaccagacctggcaggagagccagcacggcagccccagccccagcgtgatcagcaaggccaccgagaaggagaccttcaccgacagcaaccagagcaagaccaagaagcccggcatcagcgacgtgaccgactacagcgacagaggcgacagcgacatggacgaggccacctacagcagcagccaggaccaccagacccccaagcaggagagcagcagcagcgtgaacaccagcaacaagatgaacttcaagaccttcagcagcagcccccccaagcccggcgacatcttcgaggtggagctggccaagaacgacaacagcctgggcatcagcgtgaccggcggcgtgaacaccagcgtgagacacggcggcatctacgtgaaggccgtgatcccccagggcgccgccgagagcgacggcagaatccacaagggcgacagagtgctggccgtgaacggcgtgagcctggagggcgccacccacaagcaggccgtggagaccctgagaaacaccggccaggtggtgcacctgctgctggagaagggccagagccccaccagcaaggagcacgtgcccgtgaccccccagtgcaccctgagcgaccagaacgcccagggccagggccccgagaaggtgaagaagaccacccaggtgaaggactacagcttcgtgaccgaggagaacaccttcgaggtgaagctgttcaagaacagcagcggcctgggcttcagcttcagcagagaggacaacctgatccccgagcagatcaacgccagcatcgtgagagtgaagaagctgttccccggccagcccgccgccgagagcggcaagatcgacgtgggcgacgtgatcctgaaggtgaacggcgccagcctgaagggcctgagccagcaggaggtgatcagcgccctgagaggcaccgcccccgaggtgttcctgctgctgtgcagacccccccccggcgtgctgcccgagatcgacaccgccctgctgacccccctgcagagccccgcccaggtgctgcccaacagcagcaaggacagcagccagcccagctgcgtggagcagagcaccagcagcgacgagaacgagatgagcgacaagagcaagaagcagtgcaagagccccagcagaagagacagctacagcgacagcagcggcagcggcgaggacgacctggtgaccgcccccgccaacatcagcaacagcacctggagcagcgccctgcaccagaccctgagcaacatggtgagccaggcccagagccaccacgaggcccccaagagccaggaggacaccatctgcaccatgttctactacccccagaagatccccaacaagcccgagttcgaggacagcaaccccagccccctgccccccgacatggcccccggccagagctaccagccccagagcgagagcgccagcagcagcagcatggacaagtaccacatccaccacatcagcgagcccaccagacaggagaactggacccccctgaagaacgacctggagaaccacctggaggacttcgagctggaggtggagctgctgatcaccctgatcaagagcgagaagggcagcctgggcttcaccgtgaccaagggcaaccagagaatcggctgctacgtgcacgacgtgatccaggaccccgccaagagcgacggcagactgaagcccggcgacagactgatcaaggtgaacgacaccgacgtgaccaacatgacccacaccgacgccgtgaacctgctgagagccgccagcaagaccgtgagactggtgatcggcagagtgctggagctgcccagaatccccatgctgccccacctgctgcccgacatcaccctgacctgcaacaaggaggagctgggcttcagcctgtgcggcggccacgacagcctgtaccaggtggtgtacatcagcgacatcaaccccagaagcgtggccgccatcgagggcaacctgcagctgctggacgtgatccactacgtgaacggcgtgagcacccagggcatgaccctggaggaggtgaacagagccctggacatgagcctgcccagcctggtgctgaaggccaccagaaacgacctgcccgtggtgcccagcagcaagagaagcgccgtgagcgcccccaagagcaccaagggcaacggcagctacagcgtgggcagctgcagccagcccgccctgacccccaacgacagcttcagcaccgtggccggcgaggagatcaacgagatcagctaccccaagggcaagtgcagcacctaccagatcaagggcagccccaacctgaccctgcccaaggagagctacatccaggaggacgacatctacgacgacagccaggaggccgaggtgatccagagcctgctggacgtggtggacgaggaggcccagaacctgctgaacgagaacaacgccgccggctacagctgcggccccggcaccctgaagatgaacggcaagctgagcgaggagagaaccgaggacaccgactgcgacggcagccccctgcccgagtacttcaccgaggccaccaagatgaacggctgcgaggagtactgcgaggagaaggtgaagagcgagagcctgatccagaagccccaggagaagaagaccgacgacgacgagatcacctggggcaacgacgagctgcccatcgagagaaccaaccacgaggacagcgacaaggaccacagcttcctgaccaacgacgagctggccgtgctgcccgtggtgaaggtgctgcccagcggcaagtacaccggcgccaacctgaagagcgtgatcagagtgctgagaggcctgctggaccagggcatccccagcaaggagctggagaacctgcaggagctgaagcccctggaccagtgcctgatcggccagaccaaggagaacagaagaaagaacagatacaagaacatcctgccctacgacgccaccagagtgcccctgggcgacgagggcggctacatcaacgccagcttcatcaagatccccgtgggcaaggaggagttcgtgtacatcgcctgccagggccccctgcccaccaccgtgggcgacttctggcagatgatctgggagcagaagagcaccgtgatcgccatgatgacccaggaggtggagggcgagaagatcaagtgccagagatactggcccaacatcctgggcaagaccaccatggtgagcaacagactgagactggccctggtgagaatgcagcagctgaagggcttcgtggtgagagccatgaccctggaggacatccagaccagagaggtgagacacatcagccacctgaacttcaccgcctggcccgaccacgacacccccagccagcccgacgacctgctgaccttcatcagctacatgagacacatccacagaagcggccccatcatcacccactgcagcgccggcatcggcagaagcggcaccctgatctgcatcgacgtggtgctgggcctgatcagccaggacctggacttcgacatcagcgacctggtgagatgcatgagactgcagagacacggcatggtgcagaccgaggaccagtacatcttctgctaccaggtgatcctgtacgtgctgaccagactgcaggccgaggaggagcagaagcagcagccccagctgctgaagtag

SEQ ID NO: 95465 - DNA, 7305 bp, Artificial Sequence
  Description of Artificial Sequence: Synthetic coding sequence
cagttcctgttcaccaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgatctacgccagagtgagcgtgagaaccgtgctggacgcctgcagcgcccacatcagaaacagcaactgcgcccccagcttcagctacgtgaagcacctggtgaagctggtgctgggcaacctgagcggcaccgaccagctgagctgcaacagcgagcagaagcccgacagaagccaggccatcagagacagactgagaggcaagggcctgcccaccggcagaagcagcaccagcgacgtgctggacatccagaagccccccctgagccaccagaccttcctgaacaagggcctgagcaagagcatgggcttcctgagcatcaaggacacccaggacgagaactacttcaaggacatcctgagcgacaacagcggcagagaggacagcgagaacaccttcagcccctaccagttcaagaccagcggccccgagaagaagcccatccccggcatcgacgtgctgagcaagaagaagatctgggccagcagcatggacctgctgtgcaccgccgacagagacttcagcagcggcgagaccgccacctacagaagatgccaccccgaggccgtgaccgtgagaaccagcaccacccccagaaagaaggaggccagatacagcgacggcagcatcgccctggacatcttcggcccccagaagatggaccccatctaccacaccagagagctgcccaccagcagcgccatcagcagcgccctggacagaatcagagagagacagaagaagctgcaggtgctgagagaggccatgaacgtggaggagcccgtgagaagatacaagacctaccacggcgacgtgttcagcaccagcagcgagagccccagcatcatcagcagcgagagcgacttcagacaggtgagaagaagcgaggccagcaagagattcgagagcagcagcggcctgcccggcgtggacgagaccctgagccagggccagagccagagacccagcagacagtacgagacccccttcgagggcaacctgatcaaccaggagatcatgctgaagagacaggaggaggagctgatgcagctgcaggccaagatggccctgagacagagcagactgagcctgtaccccggcgacaccatcaaggccagcatgctggacatcaccagagaccccctgagagagatcgccctggagaccgccatgacccagagaaagctgagaaacttcttcggccccgagttcgtgaagatgaccatcgagcccttcatcagcctggacctgcccagaagcatcctgaccaagaagggcaagaacgaggacaacagaagaaaggtgaacatcatgctgctgaacggccagagactggagctgacctgcgacaccaagaccatctgcaaggacgtgttcgacatggtggtggcccacatcggcctggtggagcaccacctgttcgccctggccaccctgaaggacaacgagtacttcttcgtggaccccgacctgaagctgaccaaggtggcccccgagggctggaaggaggagcccaagaagaagaccaaggccaccgtgaacttcaccctgttcttcagaatcaagttcttcatggacgacgtgagcctgatccagcacaccctgacctgccaccagtactacctgcagctgagaaaggacatcctggaggagagaatgcactgcgacgacgagaccagcctgctgctggccagcctggccctgcaggccgagtacggcgactaccagcccgaggtgcacggcgtgagctacttcagaatggagcactacctgcccgccagagtgatggagaagctggacctgagctacatcaaggaggagctgcccaagctgcacaacacctacgtgggcgccagcgagaaggagaccgagctggagttcctgaaggtgtgccagagactgaccgagtacggcgtgcacttccacagagtgcaccccgagaagaagagccagaccggcatcctgctgggcgtgtgcagcaagggcgtgctggtgttcgaggtgcacaacggcgtgagaaccctggtgctgagattcccctggagagagaccaagaagatcagcttcagcaagaagaagatcaccctgcagaacaccagcgacggcatcaagcacggcttccagaccgacaacagcaagatctgccagtacctgctgcacctgtgcagctaccagcacaagttccagctgcagatgagagccagacagagcaaccaggacgcccaggacatcgagagagccagcttcagaagcctgaacctgcaggccgagagcgtgagaggcttcaacatgggcagagccatcagcaccggcagcctggccagcagcaccctgaacaagctggccgtgagacccctgagcgtgcaggccgagatcctgaagagactgagctgcagcgagctgagcctgtaccagcccctgcagaacagcagcaaggagaagaacgacaaggccagctgggaggagaagcccagagagatgagcaagagctaccacgacctgagccaggccagcctgtacccccacagaaagaacgtgatcgtgaacatggagccccccccccagaccgtggccgagctggtgggcaagcccagccaccagatgagcagaagcgacgccgagagcctggccggcgtgaccaagctgaacaacagcaagagcgtggccagcctgaacagaagccccgagagaagaaagcacgagagcgacagcagcagcatcgaggaccccggccaggcctacgtgctggacgtgctgcacaagagatggagcatcgtgagcagccccgagagagagatcaccctggtgaacctgaagaaggacgccaagtacggcctgggcttccagatcatcggcggcgagaagatgggcagactggacctgggcatcttcatcagcagcgtggcccccggcggccccgccgacctggacggctgcctgaagcccggcgacagactgatcagcgtgaacagcgtgagcctggagggcgtgagccaccacgccgccatcgagatcctgcagaacgcccccgaggacgtgaccctggtgatcagccagcccaaggagaagatcagcaaggtgcccagcacccccgtgcacctgaccaacgagatgaagaactacatgaagaagagcagctacatgcaggacagcgccatcgacagcagcagcaaggaccaccactggagcagaggcaccctgagacacatcagcgagaacagcttcggccccagcggcggcctgagagagggcagcctgagcagccaggacagcagaaccgagagcgccagcctgagccagagccaggtgaacggcttcttcgccagccacctgggcgaccagacctggcaggagagccagcacggcagccccagccccagcgtgatcagcaaggccaccgagaaggagaccttcaccgacagcaaccagagcaagaccaagaagcccggcatcagcgacgtgaccgactacagcgacagaggcgacagcgacatggacgaggccacctacagcagcagccaggaccaccagacccccaagcaggagagcagcagcagcgtgaacaccagcaacaagatgaacttcaagaccttcagcagcagcccccccaagcccggcgacatcttcgaggtggagctggccaagaacgacaacagcctgggcatcagcgtgaccggcggcgtgaacaccagcgtgagacacggcggcatctacgtgaaggccgtgatcccccagggcgccgccgagagcgacggcagaatccacaagggcgacagagtgctggccgtgaacggcgtgagcctggagggcgccacccacaagcaggccgtggagaccctgagaaacaccggccaggtggtgcacctgctgctggagaagggccagagccccaccagcaaggagcacgtgcccgtgaccccccagtgcaccctgagcgaccagaacgcccagggccagggccccgagaaggtgaagaagaccacccaggtgaaggactacagcttcgtgaccgaggagaacaccttcgaggtgaagctgttcaagaacagcagcggcctgggcttcagcttcagcagagaggacaacctgatccccgagcagatcaacgccagcatcgtgagagtgaagaagctgttccccggccagcccgccgccgagagcggcaagatcgacgtgggcgacgtgatcctgaaggtgaacggcgccagcctgaagggcctgagccagcaggaggtgatcagcgccctgagaggcaccgcccccgaggtgttcctgctgctgtgcagacccccccccggcgtgctgcccgagatcgacaccgccctgctgacccccctgcagagccccgcccaggtgctgcccaacagcagcaaggacagcagccagcccagctgcgtggagcagagcaccagcagcgacgagaacgagatgagcgacaagagcaagaagcagtgcaagagccccagcagaagagacagctacagcgacagcagcggcagcggcgaggacgacctggtgaccgcccccgccaacatcagcaacagcacctggagcagcgccctgcaccagaccctgagcaacatggtgagccaggcccagagccaccacgaggcccccaagagccaggaggacaccatctgcaccatgttctactacccccagaagatccccaacaagcccgagttcgaggacagcaaccccagccccctgccccccgacatggcccccggccagagctaccagccccagagcgagagcgccagcagcagcagcatggacaagtaccacatccaccacatcagcgagcccaccagacaggagaactggacccccctgaagaacgacctggagaaccacctggaggacttcgagctggaggtggagctgctgatcaccctgatcaagagcgagaagggcagcctgggcttcaccgtgaccaagggcaaccagagaatcggctgctacgtgcacgacgtgatccaggaccccgccaagagcgacggcagactgaagcccggcgacagactgatcaaggtgaacgacaccgacgtgaccaacatgacccacaccgacgccgtgaacctgctgagagccgccagcaagaccgtgagactggtgatcggcagagtgctggagctgcccagaatccccatgctgccccacctgctgcccgacatcaccctgacctgcaacaaggaggagctgggcttcagcctgtgcggcggccacgacagcctgtaccaggtggtgtacatcagcgacatcaaccccagaagcgtggccgccatcgagggcaacctgcagctgctggacgtgatccactacgtgaacggcgtgagcacccagggcatgaccctggaggaggtgaacagagccctggacatgagcctgcccagcctggtgctgaaggccaccagaaacgacctgcccgtggtgcccagcagcaagagaagcgccgtgagcgcccccaagagcaccaagggcaacggcagctacagcgtgggcagctgcagccagcccgccctgacccccaacgacagcttcagcaccgtggccggcgaggagatcaacgagatcagctaccccaagggcaagtgcagcacctaccagatcaagggcagccccaacctgaccctgcccaaggagagctacatccaggaggacgacatctacgacgacagccaggaggccgaggtgatccagagcctgctggacgtggtggacgaggaggcccagaacctgctgaacgagaacaacgccgccggctacagctgcggccccggcaccctgaagatgaacggcaagctgagcgaggagagaaccgaggacaccgactgcgacggcagccccctgcccgagtacttcaccgaggccaccaagatgaacggctgcgaggagtactgcgaggagaaggtgaagagcgagagcctgatccagaagccccaggagaagaagaccgacgacgacgagatcacctggggcaacgacgagctgcccatcgagagaaccaaccacgaggacagcgacaaggaccacagcttcctgaccaacgacgagctggccgtgctgcccgtggtgaaggtgctgcccagcggcaagtacaccggcgccaacctgaagagcgtgatcagagtgctgagaggcctgctggaccagggcatccccagcaaggagctggagaacctgcaggagctgaagcccctggaccagtgcctgatcggccagaccaaggagaacagaagaaagaacagatacaagaacatcctgccctacgacgccaccagagtgcccctgggcgacgagggcggctacatcaacgccagcttcatcaagatccccgtgggcaaggaggagttcgtgtacatcgcctgccagggccccctgcccaccaccgtgggcgacttctggcagatgatctgggagcagaagagcaccgtgatcgccatgatgacccaggaggtggagggcgagaagatcaagtgccagagatactggcccaacatcctgggcaagaccaccatggtgagcaacagactgagactggccctggtgagaatgcagcagctgaagggcttcgtggtgagagccatgaccctggaggacatccagaccagagaggtgagacacatcagccacctgaacttcaccgcctggcccgaccacgacacccccagccagcccgacgacctgctgaccttcatcagctacatgagacacatccacagaagcggccccatcatcacccactgcagcgccggcatcggcagaagcggcaccctgatctgcatcgacgtggtgctgggcctgatcagccaggacctggacttcgacatcagcgacctggtgagatgcatgagactgcagagacacggcatggtgcagaccgaggaccagtacatcttctgctaccaggtgatcctgtacgtgctgaccagactgcaggccgaggaggagcagaagcagcagccccagctgctgaagtag

SEQ ID NO: 95466 - DNA, 7458 bp, Artificial Sequence
  Description of Artificial Sequence: Synthetic coding sequence
atgcacgtgagcctggccgaggccctggaggtgagaggcggccccctgcaggaggaggagatctgggccgtgctgaaccagagcgccgagagcctgcaggagctgttcagaaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgatctacgccagagtgagcgtgagaaccgtgctggacgcctgcagcgcccacatcagaaacagcaactgcgcccccagcttcagctacgtgaagcacctggtgaagctggtgctgggcaacctgagcggcaccgaccagctgagctgcaacagcgagcagaagcccgacagaagccaggccatcagagacagactgagaggcaagggcctgcccaccggcagaagcagcaccagcgacgtgctggacatccagaagccccccctgagccaccagaccttcctgaacaagggcctgagcaagagcatgggcttcctgagcatcaaggacacccaggacgagaactacttcaaggacatcctgagcgacaacagcggcagagaggacagcgagaacaccttcagcccctaccagttcaagaccagcggccccgagaagaagcccatccccggcatcgacgtgctgagcaagaagaagatctgggccagcagcatggacctgctgtgcaccgccgacagagacttcagcagcggcgagaccgccacctacagaagatgccaccccgaggccgtgaccgtgagaaccagcaccacccccagaaagaaggaggccagatacagcgacggcagcatcgccctggacatcttcggcccccagaagatggaccccatctaccacaccagagagctgcccaccagcagcgccatcagcagcgccctggacagaatcagagagagacagaagaagctgcaggtgctgagagaggccatgaacgtggaggagcccgtgagaagatacaagacctaccacggcgacgtgttcagcaccagcagcgagagccccagcatcatcagcagcgagagcgacttcagacaggtgagaagaagcgaggccagcaagagattcgagagcagcagcggcctgcccggcgtggacgagaccctgagccagggccagagccagagacccagcagacagtacgagacccccttcgagggcaacctgatcaaccaggagatcatgctgaagagacaggaggaggagctgatgcagctgcaggccaagatggccctgagacagagcagactgagcctgtaccccggcgacaccatcaaggccagcatgctggacatcaccagagaccccctgagagagatcgccctggagaccgccatgacccagagaaagctgagaaacttcttcggccccgagttcgtgaagatgaccatcgagcccttcatcagcctggacctgcccagaagcatcctgaccaagaagggcaagaacgaggacaacagaagaaaggtgaacatcatgctgctgaacggccagagactggagctgacctgcgacaccaagaccatctgcaaggacgtgttcgacatggtggtggcccacatcggcctggtggagcaccacctgttcgccctggccaccctgaaggacaacgagtacttcttcgtggaccccgacctgaagctgaccaaggtggcccccgagggctggaaggaggagcccaagaagaagaccaaggccaccgtgaacttcaccctgttcttcagaatcaagttcttcatggacgacgtgagcctgatccagcacaccctgacctgccaccagtactacctgcagctgagaaaggacatcctggaggagagaatgcactgcgacgacgagaccagcctgctgctggccagcctggccctgcaggccgagtacggcgactaccagcccgaggtgcacggcgtgagctacttcagaatggagcactacctgcccgccagagtgatggagaagctggacctgagctacatcaaggaggagctgcccaagctgcacaacacctacgtgggcgccagcgagaaggagaccgagctggagttcctgaaggtgtgccagagactgaccgagtacggcgtgcacttccacagagtgcaccccgagaagaagagccagaccggcatcctgctgggcgtgtgcagcaagggcgtgctggtgttcgaggtgcacaacggcgtgagaaccctggtgctgagattcccctggagagagaccaagaagatcagcttcagcaagaagaagatcaccctgcagaacaccagcgacggcatcaagcacggcttccagaccgacaacagcaagatctgccagtacctgctgcacctgtgcagctaccagcacaagttccagctgcagatgagagccagacagagcaaccaggacgcccaggacatcgagagagccagcttcagaagcctgaacctgcaggccgagagcgtgagaggcttcaacatgggcagagccatcagcaccggcagcctggccagcagcaccctgaacaagctggccgtgagacccctgagcgtgcaggccgagatcctgaagagactgagctgcagcgagctgagcctgtaccagcccctgcagaacagcagcaaggagaagaacgacaaggccagctgggaggagaagcccagagagatgagcaagagctaccacgacctgagccaggccagcctgtacccccacagaaagaacgtgatcgtgaacatggagccccccccccagaccgtggccgagctggtgggcaagcccagccaccagatgagcagaagcgacgccgagagcctggccggcgtgaccaagctgaacaacagcaagagcgtggccagcctgaacagaagccccgagagaagaaagcacgagagcgacagcagcagcatcgaggaccccggccaggcctacgtgctgggcatgaccatgcacagcagcggcaacagcagcagccaggtgcccctgaaggagaacgacgtgctgcacaagagatggagcatcgtgagcagccccgagagagagatcaccctggtgaacctgaagaaggacgccaagtacggcctgggcttccagatcatcggcggcgagaagatgggcagactggacctgggcatcttcatcagcagcgtggcccccggcggccccgccgacctggacggctgcctgaagcccggcgacagactgatcagcgtgaacagcgtgagcctggagggcgtgagccaccacgccgccatcgagatcctgcagaacgcccccgaggacgtgaccctggtgatcagccagcccaaggagaagatcagcaaggtgcccagcacccccgtgcacctgaccaacgagatgaagaactacatgaagaagagcagctacatgcaggacagcgccatcgacagcagcagcaaggaccaccactggagcagaggcaccctgagacacatcagcgagaacagcttcggccccagcggcggcctgagagagggcagcctgagcagccaggacagcagaaccgagagcgccagcctgagccagagccaggtgaacggcttcttcgccagccacctgggcgaccagacctggcaggagagccagcacggcagccccagccccagcgtgatcagcaaggccaccgagaaggagaccttcaccgacagcaaccagagcaagaccaagaagcccggcatcagcgacgtgaccgactacagcgacagaggcgacagcgacatggacgaggccacctacagcagcagccaggaccaccagacccccaagcaggagagcagcagcagcgtgaacaccagcaacaagatgaacttcaagaccttcagcagcagcccccccaagcccggcgacatcttcgaggtggagctggccaagaacgacaacagcctgggcatcagcgtgaccggcggcgtgaacaccagcgtgagacacggcggcatctacgtgaaggccgtgatcccccagggcgccgccgagagcgacggcagaatccacaagggcgacagagtgctggccgtgaacggcgtgagcctggagggcgccacccacaagcaggccgtggagaccctgagaaacaccggccaggtggtgcacctgctgctggagaagggccagagccccaccagcaaggagcacgtgcccgtgaccccccagtgcaccctgagcgaccagaacgcccagggccagggccccgagaaggtgaagaagaccacccaggtgaaggactacagcttcgtgaccgaggagaacaccttcgaggtgaagctgttcaagaacagcagcggcctgggcttcagcttcagcagagaggacaacctgatccccgagcagatcaacgccagcatcgtgagagtgaagaagctgttccccggccagcccgccgccgagagcggcaagatcgacgtgggcgacgtgatcctgaaggtgaacggcgccagcctgaagggcctgagccagcaggaggtgatcagcgccctgagaggcaccgcccccgaggtgttcctgctgctgtgcagacccccccccggcgtgctgcccgagatcgacaccgccctgctgacccccctgcagagccccgcccaggtgctgcccaacagcagcaaggacagcagccagcccagctgcgtggagcagagcaccagcagcgacgagaacgagatgagcgacaagagcaagaagcagtgcaagagccccagcagaagagacagctacagcgacagcagcggcagcggcgaggacgacctggtgaccgcccccgccaacatcagcaacagcacctggagcagcgccctgcaccagaccctgagcaacatggtgagccaggcccagagccaccacgaggcccccaagagccaggaggacaccatctgcaccatgttctactacccccagaagatccccaacaagcccgagttcgaggacagcaaccccagccccctgccccccgacatggcccccggccagagctaccagccccagagcgagagcgccagcagcagcagcatggacaagtaccacatccaccacatcagcgagcccaccagacaggagaactggacccccctgaagaacgacctggagaaccacctggaggacttcgagctggaggtggagctgctgatcaccctgatcaagagcgagaagggcagcctgggcttcaccgtgaccaagggcaaccagagaatcggctgctacgtgcacgacgtgatccaggaccccgccaagagcgacggcagactgaagcccggcgacagactgatcaaggtgaacgacaccgacgtgaccaacatgacccacaccgacgccgtgaacctgctgagagccgccagcaagaccgtgagactggtgatcggcagagtgctggagctgcccagaatccccatgctgccccacctgctgcccgacatcaccctgacctgcaacaaggaggagctgggcttcagcctgtgcggcggccacgacagcctgtaccaggtggtgtacatcagcgacatcaaccccagaagcgtggccgccatcgagggcaacctgcagctgctggacgtgatccactacgtgaacggcgtgagcacccagggcatgaccctggaggaggtgaacagagccctggacatgagcctgcccagcctggtgctgaaggccaccagaaacgacctgcccgtggtgcccagcagcaagagaagcgccgtgagcgcccccaagagcaccaagggcaacggcagctacagcgtgggcagctgcagccagcccgccctgacccccaacgacagcttcagcaccgtggccggcgaggagatcaacgagatcagctaccccaagggcaagtgcagcacctaccagatcaagggcagccccaacctgaccctgcccaaggagagctacatccaggaggacgacatctacgacgacagccaggaggccgaggtgatccagagcctgctggacgtggtggacgaggaggcccagaacctgctgaacgagaacaacgccgccggctacagctgcggccccggcaccctgaagatgaacggcaagctgagcgaggagagaaccgaggacaccgactgcgacggcagccccctgcccgagtacttcaccgaggccaccaagatgaacggctgcgaggagtactgcgaggagaaggtgaagagcgagagcctgatccagaagccccaggagaagaagaccgacgacgacgagatcacctggggcaacgacgagctgcccatcgagagaaccaaccacgaggacagcgacaaggaccacagcttcctgaccaacgacgagctggccgtgctgcccgtggtgaaggtgctgcccagcggcaagtacaccggcgccaacctgaagagcgtgatcagagtgctgagaggcctgctggaccagggcatccccagcaaggagctggagaacctgcaggagctgaagcccctggaccagtgcctgatcggccagaccaaggagaacagaagaaagaacagatacaagaacatcctgccctacgacgccaccagagtgcccctgggcgacgagggcggctacatcaacgccagcttcatcaagatccccgtgggcaaggaggagttcgtgtacatcgcctgccagggccccctgcccaccaccgtgggcgacttctggcagatgatctgggagcagaagagcaccgtgatcgccatgatgacccaggaggtggagggcgagaagatcaagtgccagagatactggcccaacatcctgggcaagaccaccatggtgagcaacagactgagactggccctggtgagaatgcagcagctgaagggcttcgtggtgagagccatgaccctggaggacatccagaccagagaggtgagacacatcagccacctgaacttcaccgcctggcccgaccacgacacccccagccagcccgacgacctgctgaccttcatcagctacatgagacacatccacagaagcggccccatcatcacccactgcagcgccggcatcggcagaagcggcaccctgatctgcatcgacgtggtgctgggcctgatcagccaggacctggacttcgacatcagcgacctggtgagatgcatgagactgcagagacacggcatggtgcagaccgaggaccagtacatcttctgctaccaggtgatcctgtacgtgctgaccagactgcaggccgaggaggagcagaagcagcagccccagctgctgaagtag

SEQ ID NO: 95467 - DNA, 7401 bp, Artificial Sequence
  Description of Artificial Sequence: Synthetic coding sequence
atgcacgtgagcctggccgaggccctggaggtgagaggcggccccctgcaggaggaggagatctgggccgtgctgaaccagagcgccgagagcctgcaggagctgttcagaaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgatctacgccagagtgagcgtgagaaccgtgctggacgcctgcagcgcccacatcagaaacagcaactgcgcccccagcttcagctacgtgaagcacctggtgaagctggtgctgggcaacctgagcggcaccgaccagctgagctgcaacagcgagcagaagcccgacagaagccaggccatcagagacagactgagaggcaagggcctgcccaccggcagaagcagcaccagcgacgtgctggacatccagaagccccccctgagccaccagaccttcctgaacaagggcctgagcaagagcatgggcttcctgagcatcaaggacacccaggacgagaactacttcaaggacatcctgagcgacaacagcggcagagaggacagcgagaacaccttcagcccctaccagttcaagaccagcggccccgagaagaagcccatccccggcatcgacgtgctgagcaagaagaagatctgggccagcagcatggacctgctgtgcaccgccgacagagacttcagcagcggcgagaccgccacctacagaagatgccaccccgaggccgtgaccgtgagaaccagcaccacccccagaaagaaggaggccagatacagcgacggcagcatcgccctggacatcttcggcccccagaagatggaccccatctaccacaccagagagctgcccaccagcagcgccatcagcagcgccctggacagaatcagagagagacagaagaagctgcaggtgctgagagaggccatgaacgtggaggagcccgtgagaagatacaagacctaccacggcgacgtgttcagcaccagcagcgagagccccagcatcatcagcagcgagagcgacttcagacaggtgagaagaagcgaggccagcaagagattcgagagcagcagcggcctgcccggcgtggacgagaccctgagccagggccagagccagagacccagcagacagtacgagacccccttcgagggcaacctgatcaaccaggagatcatgctgaagagacaggaggaggagctgatgcagctgcaggccaagatggccctgagacagagcagactgagcctgtaccccggcgacaccatcaaggccagcatgctggacatcaccagagaccccctgagagagatcgccctggagaccgccatgacccagagaaagctgagaaacttcttcggccccgagttcgtgaagatgaccatcgagcccttcatcagcctggacctgcccagaagcatcctgaccaagaagggcaagaacgaggacaacagaagaaaggtgaacatcatgctgctgaacggccagagactggagctgacctgcgacaccaagaccatctgcaaggacgtgttcgacatggtggtggcccacatcggcctggtggagcaccacctgttcgccctggccaccctgaaggacaacgagtacttcttcgtggaccccgacctgaagctgaccaaggtggcccccgagggctggaaggaggagcccaagaagaagaccaaggccaccgtgaacttcaccctgttcttcagaatcaagttcttcatggacgacgtgagcctgatccagcacaccctgacctgccaccagtactacctgcagctgagaaaggacatcctggaggagagaatgcactgcgacgacgagaccagcctgctgctggccagcctggccctgcaggccgagtacggcgactaccagcccgaggtgcacggcgtgagctacttcagaatggagcactacctgcccgccagagtgatggagaagctggacctgagctacatcaaggaggagctgcccaagctgcacaacacctacgtgggcgccagcgagaaggagaccgagctggagttcctgaaggtgtgccagagactgaccgagtacggcgtgcacttccacagagtgcaccccgagaagaagagccagaccggcatcctgctgggcgtgtgcagcaagggcgtgctggtgttcgaggtgcacaacggcgtgagaaccctggtgctgagattcccctggagagagaccaagaagatcagcttcagcaagaagaagatcaccctgcagaacaccagcgacggcatcaagcacggcttccagaccgacaacagcaagatctgccagtacctgctgcacctgtgcagctaccagcacaagttccagctgcagatgagagccagacagagcaaccaggacgcccaggacatcgagagagccagcttcagaagcctgaacctgcaggccgagagcgtgagaggcttcaacatgggcagagccatcagcaccggcagcctggccagcagcaccctgaacaagctggccgtgagacccctgagcgtgcaggccgagatcctgaagagactgagctgcagcgagctgagcctgtaccagcccctgcagaacagcagcaaggagaagaacgacaaggccagctgggaggagaagcccagagagatgagcaagagctaccacgacctgagccaggccagcctgtacccccacagaaagaacgtgatcgtgaacatggagccccccccccagaccgtggccgagctggtgggcaagcccagccaccagatgagcagaagcgacgccgagagcctggccggcgtgaccaagctgaacaacagcaagagcgtggccagcctgaacagaagccccgagagaagaaagcacgagagcgacagcagcagcatcgaggaccccggccaggcctacgtgctggacgtgctgcacaagagatggagcatcgtgagcagccccgagagagagatcaccctggtgaacctgaagaaggacgccaagtacggcctgggcttccagatcatcggcggcgagaagatgggcagactggacctgggcatcttcatcagcagcgtggcccccggcggccccgccgacctggacggctgcctgaagcccggcgacagactgatcagcgtgaacagcgtgagcctggagggcgtgagccaccacgccgccatcgagatcctgcagaacgcccccgaggacgtgaccctggtgatcagccagcccaaggagaagatcagcaaggtgcccagcacccccgtgcacctgaccaacgagatgaagaactacatgaagaagagcagctacatgcaggacagcgccatcgacagcagcagcaaggaccaccactggagcagaggcaccctgagacacatcagcgagaacagcttcggccccagcggcggcctgagagagggcagcctgagcagccaggacagcagaaccgagagcgccagcctgagccagagccaggtgaacggcttcttcgccagccacctgggcgaccagacctggcaggagagccagcacggcagccccagccccagcgtgatcagcaaggccaccgagaaggagaccttcaccgacagcaaccagagcaagaccaagaagcccggcatcagcgacgtgaccgactacagcgacagaggcgacagcgacatggacgaggccacctacagcagcagccaggaccaccagacccccaagcaggagagcagcagcagcgtgaacaccagcaacaagatgaacttcaagaccttcagcagcagcccccccaagcccggcgacatcttcgaggtggagctggccaagaacgacaacagcctgggcatcagcgtgaccggcggcgtgaacaccagcgtgagacacggcggcatctacgtgaaggccgtgatcccccagggcgccgccgagagcgacggcagaatccacaagggcgacagagtgctggccgtgaacggcgtgagcctggagggcgccacccacaagcaggccgtggagaccctgagaaacaccggccaggtggtgcacctgctgctggagaagggccagagccccaccagcaaggagcacgtgcccgtgaccccccagtgcaccctgagcgaccagaacgcccagggccagggccccgagaaggtgaagaagaccacccaggtgaaggactacagcttcgtgaccgaggagaacaccttcgaggtgaagctgttcaagaacagcagcggcctgggcttcagcttcagcagagaggacaacctgatccccgagcagatcaacgccagcatcgtgagagtgaagaagctgttccccggccagcccgccgccgagagcggcaagatcgacgtgggcgacgtgatcctgaaggtgaacggcgccagcctgaagggcctgagccagcaggaggtgatcagcgccctgagaggcaccgcccccgaggtgttcctgctgctgtgcagacccccccccggcgtgctgcccgagatcgacaccgccctgctgacccccctgcagagccccgcccaggtgctgcccaacagcagcaaggacagcagccagcccagctgcgtggagcagagcaccagcagcgacgagaacgagatgagcgacaagagcaagaagcagtgcaagagccccagcagaagagacagctacagcgacagcagcggcagcggcgaggacgacctggtgaccgcccccgccaacatcagcaacagcacctggagcagcgccctgcaccagaccctgagcaacatggtgagccaggcccagagccaccacgaggcccccaagagccaggaggacaccatctgcaccatgttctactacccccagaagatccccaacaagcccgagttcgaggacagcaaccccagccccctgccccccgacatggcccccggccagagctaccagccccagagcgagagcgccagcagcagcagcatggacaagtaccacatccaccacatcagcgagcccaccagacaggagaactggacccccctgaagaacgacctggagaaccacctggaggacttcgagctggaggtggagctgctgatcaccctgatcaagagcgagaagggcagcctgggcttcaccgtgaccaagggcaaccagagaatcggctgctacgtgcacgacgtgatccaggaccccgccaagagcgacggcagactgaagcccggcgacagactgatcaaggtgaacgacaccgacgtgaccaacatgacccacaccgacgccgtgaacctgctgagagccgccagcaagaccgtgagactggtgatcggcagagtgctggagctgcccagaatccccatgctgccccacctgctgcccgacatcaccctgacctgcaacaaggaggagctgggcttcagcctgtgcggcggccacgacagcctgtaccaggtggtgtacatcagcgacatcaaccccagaagcgtggccgccatcgagggcaacctgcagctgctggacgtgatccactacgtgaacggcgtgagcacccagggcatgaccctggaggaggtgaacagagccctggacatgagcctgcccagcctggtgctgaaggccaccagaaacgacctgcccgtggtgcccagcagcaagagaagcgccgtgagcgcccccaagagcaccaagggcaacggcagctacagcgtgggcagctgcagccagcccgccctgacccccaacgacagcttcagcaccgtggccggcgaggagatcaacgagatcagctaccccaagggcaagtgcagcacctaccagatcaagggcagccccaacctgaccctgcccaaggagagctacatccaggaggacgacatctacgacgacagccaggaggccgaggtgatccagagcctgctggacgtggtggacgaggaggcccagaacctgctgaacgagaacaacgccgccggctacagctgcggccccggcaccctgaagatgaacggcaagctgagcgaggagagaaccgaggacaccgactgcgacggcagccccctgcccgagtacttcaccgaggccaccaagatgaacggctgcgaggagtactgcgaggagaaggtgaagagcgagagcctgatccagaagccccaggagaagaagaccgacgacgacgagatcacctggggcaacgacgagctgcccatcgagagaaccaaccacgaggacagcgacaaggaccacagcttcctgaccaacgacgagctggccgtgctgcccgtggtgaaggtgctgcccagcggcaagtacaccggcgccaacctgaagagcgtgatcagagtgctgagaggcctgctggaccagggcatccccagcaaggagctggagaacctgcaggagctgaagcccctggaccagtgcctgatcggccagaccaaggagaacagaagaaagaacagatacaagaacatcctgccctacgacgccaccagagtgcccctgggcgacgagggcggctacatcaacgccagcttcatcaagatccccgtgggcaaggaggagttcgtgtacatcgcctgccagggccccctgcccaccaccgtgggcgacttctggcagatgatctgggagcagaagagcaccgtgatcgccatgatgacccaggaggtggagggcgagaagatcaagtgccagagatactggcccaacatcctgggcaagaccaccatggtgagcaacagactgagactggccctggtgagaatgcagcagctgaagggcttcgtggtgagagccatgaccctggaggacatccagaccagagaggtgagacacatcagccacctgaacttcaccgcctggcccgaccacgacacccccagccagcccgacgacctgctgaccttcatcagctacatgagacacatccacagaagcggccccatcatcacccactgcagcgccggcatcggcagaagcggcaccctgatctgcatcgacgtggtgctgggcctgatcagccaggacctggacttcgacatcagcgacctggtgagatgcatgagactgcagagacacggcatggtgcagaccgaggaccagtacatcttctgctaccaggtgatcctgtacgtgctgaccagactgcaggccgaggaggagcagaagcagcagccccagctgctgaagtag

SEQ ID NO: 95468 - DNA, 7473 bp, Artificial Sequence
  Description of Artificial Sequence: Synthetic coding sequence
atgcacgtgagcctggccgaggccctggaggtgagaggcggccccctgcaggaggaggagatctgggccgtgctgaaccagagcgccgagagcctgcaggagctgttcagaaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgatctacgccagagtgagcgtgagaaccgtgctggacgcctgcagcgcccacatcagaaacagcaactgcgcccccagcttcagctacgtgaagcacctggtgaagctggtgctgggcaacctgagcggcaccgaccagctgagctgcaacagcgagcagaagcccgacagaagccaggccatcagagacagactgagaggcaagggcctgcccaccggcagaagcagcaccagcgacgtgctggacatccagaagccccccctgagccaccagaccttcctgaacaagggcctgagcaagagcatgggcttcctgagcatcaaggacacccaggacgagaactacttcaaggacatcctgagcgacaacagcggcagagaggacagcgagaacaccttcagcccctaccagttcaagaccagcggccccgagaagaagcccatccccggcatcgacgtgctgagcaagaagaagatctgggccagcagcatggacctgctgtgcaccgccgacagagacttcagcagcggcgagaccgccacctacagaagatgccaccccgaggccgtgaccgtgagaaccagcaccacccccagaaagaaggaggccagatacagcgacggcagcatcgccctggacatcttcggcccccagaagatggaccccatctaccacaccagagagctgcccaccagcagcgccatcagcagcgccctggacagaatcagagagagacagaagaagctgcaggtgctgagagaggccatgaacgtggaggagcccgtgagaagatacaagacctaccacggcgacgtgttcagcaccagcagcgagagccccagcatcatcagcagcgagagcgacttcagacaggtgagaagaagcgaggccagcaagagattcgagagcagcagcggcctgcccggcgtggacgagaccctgagccagggccagagccagagacccagcagacagtacgagacccccttcgagggcaacctgatcaaccaggagatcatgctgaagagacaggaggaggagctgatgcagctgcaggccaagatggccctgagacagagcagactgagcctgtaccccggcgacaccatcaaggccagcatgctggacatcaccagagaccccctgagagagatcgccctggagaccgccatgacccagagaaagctgagaaacttcttcggccccgagttcgtgaagatgaccatcgagcccttcatcagcctggacctgcccagaagcatcctgaccaagaagggcaagaacgaggacaacagaagaaaggtgaacatcatgctgctgaacggccagagactggagctgacctgcgacaccaagaccatctgcaaggacgtgttcgacatggtggtggcccacatcggcctggtggagcaccacctgttcgccctggccaccctgaaggacaacgagtacttcttcgtggaccccgacctgaagctgaccaaggtggcccccgagggctggaaggaggagcccaagaagaagaccaaggccaccgtgaacttcaccctgttcttcagaatcaagttcttcatggacgacgtgagcctgatccagcacaccctgacctgccaccagtactacctgcagctgagaaaggacatcctggaggagagaatgcactgcgacgacgagaccagcctgctgctggccagcctggccctgcaggccgagtacggcgactaccagcccgaggtgcacggcgtgagctacttcagaatggagcactacctgcccgccagagtgatggagaagctggacctgagctacatcaaggaggagctgcccaagctgcacaacacctacgtgggcgccagcgagaaggagaccgagctggagttcctgaaggtgtgccagagactgaccgagtacggcgtgcacttccacagagtgcaccccgagaagaagagccagaccggcatcctgctgggcgtgtgcagcaagggcgtgctggtgttcgaggtgcacaacggcgtgagaaccctggtgctgagattcccctggagagagaccaagaagatcagcttcagcaagaagaagatcaccctgcagaacaccagcgacggcatcaagcacggcttccagaccgacaacagcaagatctgccagtacctgctgcacctgtgcagctaccagcacaagttccagctgcagatgagagccagacagagcaaccaggacgcccaggacatcgagagagccagcttcagaagcctgaacctgcaggccgagagcgtgagaggcttcaacatgggcagagccatcagcaccggcagcctggccagcagcaccctgaacaagctggccgtgagacccctgagcgtgcaggccgagatcctgaagagactgagctgcagcgagctgagcctgtaccagcccctgcagaacagcagcaaggagaagaacgacaaggccagctgggaggagaagcccagagagatgagcaagagctaccacgacctgagccaggccagcctgtacccccacagaaagaacgtgatcgtgaacatggagccccccccccagaccgtggccgagctggtgggcaagcccagccaccagatgagcagaagcgacgccgagagcctggccggcgtgaccaagctgaacaacagcaagagcgtggccagcctgaacagaagccccgagagaagaaagcacgagagcgacagcagcagcatcgaggaccccggccaggcctacgtgctgggcatgaccatgcacagcagcggcaacagcagcagccaggtgcccctgaaggagaacgacgtgctgcacaagagatggagcatcgtgagcagccccgagagagagatcaccctggtgaacctgaagaaggacgccaagtacggcctgggcttccagatcatcggcggcgagaagatgggcagactggacctgggcatcttcatcagcagcgtggcccccggcggccccgccgacctggacggctgcctgaagcccggcgacagactgatcagcgtgaacagcgtgagcctggagggcgtgagccaccacgccgccatcgagatcctgcagaacgcccccgaggacgtgaccctggtgatcagccagcccaaggagaagatcagcaaggtgcccagcacccccgtgcacctgaccaacgagatgaagaactacatgaagaagagcagctacatgcaggacagcgccatcgacagcagcagcaaggaccaccactggagcagaggcaccctgagacacatcagcgagaacagcttcggccccagcggcggcctgagagagggcagcctgagcagccaggacagcagaaccgagagcgccagcctgagccagagccaggtgaacggcttcttcgccagccacctgggcgaccagacctggcaggagagccagcacggcagccccagccccagcgtgatcagcaaggccaccgagaaggagaccttcaccgacagcaaccagagcaagaccaagaagcccggcatcagcgacgtgaccgactacagcgacagaggcgacagcgacatggacgaggccacctacagcagcagccaggaccaccagacccccaagcaggagagcagcagcagcgtgaacaccagcaacaagatgaacttcaagaccttcagcagcagcccccccaagcccggcgacatcttcgaggtggagctggccaagaacgacaacagcctgggcatcagcgtgaccgtgctgttcgacaagggcggcgtgaacaccagcgtgagacacggcggcatctacgtgaaggccgtgatcccccagggcgccgccgagagcgacggcagaatccacaagggcgacagagtgctggccgtgaacggcgtgagcctggagggcgccacccacaagcaggccgtggagaccctgagaaacaccggccaggtggtgcacctgctgctggagaagggccagagccccaccagcaaggagcacgtgcccgtgaccccccagtgcaccctgagcgaccagaacgcccagggccagggccccgagaaggtgaagaagaccacccaggtgaaggactacagcttcgtgaccgaggagaacaccttcgaggtgaagctgttcaagaacagcagcggcctgggcttcagcttcagcagagaggacaacctgatccccgagcagatcaacgccagcatcgtgagagtgaagaagctgttccccggccagcccgccgccgagagcggcaagatcgacgtgggcgacgtgatcctgaaggtgaacggcgccagcctgaagggcctgagccagcaggaggtgatcagcgccctgagaggcaccgcccccgaggtgttcctgctgctgtgcagacccccccccggcgtgctgcccgagatcgacaccgccctgctgacccccctgcagagccccgcccaggtgctgcccaacagcagcaaggacagcagccagcccagctgcgtggagcagagcaccagcagcgacgagaacgagatgagcgacaagagcaagaagcagtgcaagagccccagcagaagagacagctacagcgacagcagcggcagcggcgaggacgacctggtgaccgcccccgccaacatcagcaacagcacctggagcagcgccctgcaccagaccctgagcaacatggtgagccaggcccagagccaccacgaggcccccaagagccaggaggacaccatctgcaccatgttctactacccccagaagatccccaacaagcccgagttcgaggacagcaaccccagccccctgccccccgacatggcccccggccagagctaccagccccagagcgagagcgccagcagcagcagcatggacaagtaccacatccaccacatcagcgagcccaccagacaggagaactggacccccctgaagaacgacctggagaaccacctggaggacttcgagctggaggtggagctgctgatcaccctgatcaagagcgagaagggcagcctgggcttcaccgtgaccaagggcaaccagagaatcggctgctacgtgcacgacgtgatccaggaccccgccaagagcgacggcagactgaagcccggcgacagactgatcaaggtgaacgacaccgacgtgaccaacatgacccacaccgacgccgtgaacctgctgagagccgccagcaagaccgtgagactggtgatcggcagagtgctggagctgcccagaatccccatgctgccccacctgctgcccgacatcaccctgacctgcaacaaggaggagctgggcttcagcctgtgcggcggccacgacagcctgtaccaggtggtgtacatcagcgacatcaaccccagaagcgtggccgccatcgagggcaacctgcagctgctggacgtgatccactacgtgaacggcgtgagcacccagggcatgaccctggaggaggtgaacagagccctggacatgagcctgcccagcctggtgctgaaggccaccagaaacgacctgcccgtggtgcccagcagcaagagaagcgccgtgagcgcccccaagagcaccaagggcaacggcagctacagcgtgggcagctgcagccagcccgccctgacccccaacgacagcttcagcaccgtggccggcgaggagatcaacgagatcagctaccccaagggcaagtgcagcacctaccagatcaagggcagccccaacctgaccctgcccaaggagagctacatccaggaggacgacatctacgacgacagccaggaggccgaggtgatccagagcctgctggacgtggtggacgaggaggcccagaacctgctgaacgagaacaacgccgccggctacagctgcggccccggcaccctgaagatgaacggcaagctgagcgaggagagaaccgaggacaccgactgcgacggcagccccctgcccgagtacttcaccgaggccaccaagatgaacggctgcgaggagtactgcgaggagaaggtgaagagcgagagcctgatccagaagccccaggagaagaagaccgacgacgacgagatcacctggggcaacgacgagctgcccatcgagagaaccaaccacgaggacagcgacaaggaccacagcttcctgaccaacgacgagctggccgtgctgcccgtggtgaaggtgctgcccagcggcaagtacaccggcgccaacctgaagagcgtgatcagagtgctgagaggcctgctggaccagggcatccccagcaaggagctggagaacctgcaggagctgaagcccctggaccagtgcctgatcggccagaccaaggagaacagaagaaagaacagatacaagaacatcctgccctacgacgccaccagagtgcccctgggcgacgagggcggctacatcaacgccagcttcatcaagatccccgtgggcaaggaggagttcgtgtacatcgcctgccagggccccctgcccaccaccgtgggcgacttctggcagatgatctgggagcagaagagcaccgtgatcgccatgatgacccaggaggtggagggcgagaagatcaagtgccagagatactggcccaacatcctgggcaagaccaccatggtgagcaacagactgagactggccctggtgagaatgcagcagctgaagggcttcgtggtgagagccatgaccctggaggacatccagaccagagaggtgagacacatcagccacctgaacttcaccgcctggcccgaccacgacacccccagccagcccgacgacctgctgaccttcatcagctacatgagacacatccacagaagcggccccatcatcacccactgcagcgccggcatcggcagaagcggcaccctgatctgcatcgacgtggtgctgggcctgatcagccaggacctggacttcgacatcagcgacctggtgagatgcatgagactgcagagacacggcatggtgcagaccgaggaccagtacatcttctgctaccaggtgatcctgtacgtgctgaccagactgcaggccgaggaggagcagaagcagcagccccagctgctgaagtag

SEQ ID NO: 95469 - DNA, 420 bp, Artificial Sequence
  Description of Artificial Sequence: Synthetic coding sequence
atgcacgtgagcctggccgaggccctggaggtgagaggcggccccctgcaggaggaggagatctgggccgtgctgaaccagagcgccgagagcctgcaggagctgttcagaaaggtgagcctggccgaccccgccgccctgggcttcatcatcagcccctggagcctgctgctgctgcccagcggcagcgtgagcttcaccgacgagaacatcagcaaccaggacctgagagccttcaccgcccccgaggtgctgcagaaccagagcctgaccagcctgagcgacgtggagaagatccacatctacagcctgggcatgaccctgtactggggcgccgactacgaggtgccccagagccagcccatcaagctgggcgaccacctgaacagcatcctgctgggcatgtgcgaggacgtgtag

SEQ ID NO: 95470 - DNA, 7473 bp, Artificial Sequence; identical to SEQ ID NO: 95468
  Description of Artificial Sequence: Synthetic coding sequence

SEQ ID NO: 95471 - DNA, 3564 bp, Artificial Sequence
  Description of Artificial Sequence: Synthetic coding sequence
atgcccttcggcctgaagctgagaagaaccagaagatacaacgtgctgagcaagaactgcttcgtgaccagaatcagactgctggacagcaacgtgatcgagtgcaccctgagcgtggagagcaccggccaggagtgcctggaggccgtggcccagagactggagctgagagagacccactacttcggcctgtggttcctgagcaagagccagcaggccagatgggtggagctggagaagcccctgaagaagcacctggacaagttcgccaacgagcccctgctgttcttcggcgtgatgttctacgtgcccaacgtgagctggctgcagcaggaggccaccagataccagtactacctgcaggtgaagaaggacgtgctggagggcagactgagatgcaccctggaccaggtgatcagactggccggcctggccgtgcaggccgacttcggcgactacaaccagttcgacagccaggacttcctgagagagtacgtgctgttccccatggacctggccctggaggaggccgtgctggaggagctgacccagaaggtggcccaggagcacaaggcccacagcggcatcctgcccgccgaggccgagctgatgtacatcaacgaggtggagagactggacggcttcggccaggagatcttccccgtgaaggacaaccacggcaactgcgtgcacctgggcatcttcttcatgggcatcttcgtgagaaacagaatcggcagacaggccgtgatctacagatggaacgacatgggcaacatcacccacaacaagagcaccatcctggtggagctgatcaacaaggaggagaccgccctgttccacaccgacgacatcgagaacgccaagtacatcagcagactgttcgccaccagacacaagttctacaagcagaacaagatctgcaccgagcagagcaacagccccccccccatcagaagacagcccacctggagcagaagcagcctgcccagacagcagccctacatcctgccccccgtgcacgtgcagtgcggcgagcactacagcgagacccacaccagccaggacagcatcttccacggcaacgaggaggccctgtactgcaacagccacaacagcctggacctgaactacctgaacggcaccgtgaccaacggcagcgtgtgcagcgtgcacagcgtgaacagcctgaactgcagccagagcttcatccaggccagccccgtgagcagcaacctgagcatccccggcagcgacatcatgagagccgactacatccccagccacagacacagcgccatcatcgtgcccagctacagacccacccccgactacgagaccgtgatgagacagatgaagagaggcatcctgcacaccgacagccagagccagagcctgagaaacctgaacatcatcaacacccacgcctacaaccagcccgaggacctggtgtacagccagcccgagatgagagagagacacccctacaccgtgccctacggcccccagggcgtgtacagcaacaagctggtgagccccagcgaccagagaaaccccaagaacaacgtggtgcccagcaagcccggcgccagcgccatcagccacaccgtgagcacccccgagctggccaacatgcagctgcagggcagccacaactacagcaccgcccacatgctgaagaactacctgttcagacccccccccccctaccccagacccagacccgccaccagcacccccgacctggccagccacagacacaagtacgtgagcggcagcagccccgacctggtgaccagaaaggtgcagctgagcgtgaagaccttccaggaggacagcagccccgtggtgcaccagagcctgcaggaggtgagcgagcccctgaccgccaccaagcaccacggcaccgtgaacaagagacacagcctggaggtgatgaacagcatggtgagaggcatggaggccatgaccctgaagagcctgcacctgcccatggccagaagaaacaccctgagagagcagggcccccccgaggagggcagcggcagccacgaggtgccccagctgccccagtaccaccacaagaagaccttcagcgacgccaccatgctgatccacagcagcgagagcgaggaggaggaggaggaggcccccgagagcgtgccccagatccccatgctgagagagaagatggagtacagcgcccagctgcaggccgccctggccagaatccccaacaagcccccccccgagtaccccggccccagaaagagcgtgagcaacggcgccctgagacaggaccaggccagcctgccccccgccatggccagagccagagtgctgagacacggccccgccaaggccatcagcatgagcagaaccgacccccccgccgtgaacggcgccagcctgggccccagcatcagcgagcccgacctgaccagcgtgaaggagagagtgaagaaggagcccgtgaaggagagacccgtgagcgagatgttcagcctggaggacagcatcatcgagagagagatgatgatcagaaacctggagaagcagaagatggccggcctggaggcccagaagagacccctgatgctggccgccctgaacggcctgagcgtggccagagtgagcggcagagaggagaacagagtggacgccaccagagtgcccatggacgagagattcagaaccctgaagaagaagctggaggagggcatggtgttcaccgagtacgagcagatccccaagaagaaggccaacggcatcttcagcaccgccgccctgcccgagaacgccgagagaagcagaatcagagaggtggtgccctacgaggagaacagagtggagctgatccccaccaaggagaacaacaccggctacatcaacgccagccacatcaaggtggtggtgggcggcgccgagtggcactacatcgccacccagggccccctgccccacacctgccacgacttctggcagatggtgtgggagcagggcgtgaacgtgatcgccatggtgaccgccgaggaggagggcggcagaaccaagagccacagatactggcccaagctgggcagcaagcacagcagcgccacctacggcaagttcaaggtgaccaccaagttcagaaccgacagcgtgtgctacgccaccaccggcctgaaggtgaagcacctgctgagcggccaggagagaaccgtgtggcacctgcagtacaccgactggcccgaccacggctgccccgaggacgtgcagggcttcctgagctacctggaggagatccagagcgtgagaagacacaccaacagcatgctggagggcaccaagaacagacacccccccatcgtggtgcactgcagcgccggcgtgggcagaaccggcgtgctgatcctgagcgagctgatgatctactgcctggagcacaacgagaaggtggaggtgcccatgatgctgagactgctgagagagcagagaatgttcatgatccagaccatcgcccagtacaagttcgtgtaccaggtgctgatccagttcctgcagaacagcagactgatctag

SEQ ID NO: 95472 - DNA, 636 bp, Artificial Sequence
  Description of Artificial Sequence: Synthetic coding sequence
atgcccttcggcctgaagctgagaagaaccagaagatacaacgtgctgagcaagaactgcttcgtgaccagaatcagactgctggacagcaacgtgatcgagtgcaccctgagcgtggagagcaccggccaggagtgcctggaggccgtggcccagagactggagctgagagagacccactacttcggcctgtggttcctgagcaagagccagcaggccagatgggtggagctggagaagcccctgaagaagcacctggacaagttcgccaacgagcccctgctgttcttcggcgtgatgttctacgtgcccaacgtgagctggctgcagcaggaggccaccagataccagtactacctgcaggtgaagaaggacgtgctggagggcagactgagatgcaccctggaccaggtgatcagactggccggcctggccgtgcaggccgacttcggcgactacaaccagttcgacagccaggacttcctgagagagtacgtgctgttccccatggacctggccctggaggaggccgtgctggaggagctgacccagaaggtggcccaggagcacaaggcccacagaaccatcatggagaccgtgtacaccctggccttcagcctgtggggcttcagctag

SEQ ID NO: 95473 - DNA, 1383 bp, Artificial Sequence
  Description of Artificial Sequence: Synthetic coding sequence
atgagcagaagcctggacagcgccagaagcttcctggagagactggaggccagaggcggcagagagggcgccgtgctggccggcgagttcagcgacatccaggcctgcagcgccgcctggaaggccgacggcgtgtgcagcaccgtggccggcagcagacccgagaacgtgagaaagaacagatacaaggacgtgctgccctacgaccagaccagagtgatcctgagcctgctgcaggaggagggccacagcgactacatcaacggcaacttcatcagaggcgtggacggcagcctggcctacatcgccacccagggccccctgccccacaccctgctggacttctggagactggtgtgggagttcggcgtgaaggtgatcctgatggcctgcagagagatcgagaacggcagaaagagatgcgagagatactgggcccaggagcaggagcccctgcagaccggcctgttctgcatcaccctgatcaaggagaagtggctgaacgaggacatcatgctgagaaccctgaaggtgaccttccagaaggagagcagaagcgtgtaccagctgcagtacatgagctggcccgacagaggcgtgcccagcagccccgaccacatgctggccatggtggaggaggccagaagactgcagggcagcggccccgagcccctgtgcgtgcactgcagcgccggctgcggcagaaccggcgtgctgtgcaccgtggactacgtgagacagctgctgctgacccagatgatcccccccgacttcagcctgttcgacgtggtgctgaagatgagaaagcagagacccgccgccgtgcagaccgaggagcagtacagattcctgtaccacaccgtggcccagatgttctgcagcaccctgcagaacgccagcccccactaccagaacatcaaggagaactgcgcccccctgtacgacgacgccctgttcctgagaaccccccaggccctgctggccatccccagaccccccggcggcgtgctgagaagcatcagcgtgcccggcagccccggccacgccatggccgacacctacgccgtggtgcagaagagaggcgcccccgccggcgccggcagcggcacccagaccggcaccggcaccggcaccggcgccagaagcgccgaggaggcccccctgtacagcaaggtgacccccagagcccagagacccggcgcccacgccgaggacgccagaggcaccctgcccggcagagtgcccgccgaccagagccccgccggcagcggcgcctacgaggacgtggccggcggcgcccagaccggcggcctgggcttcaacctgagaatcggcagacccaagggccccagagacccccccgccgagtggaccagagtgtag

SEQ ID NO: 95474 - DNA, 1248 bp, Artificial Sequence
  Description of Artificial Sequence: Synthetic coding sequence
atgcccaccaccatcgagagagagttcgaggagctggacacccagagaagatggcagcccctgtacctggagatcagaaacgagagccacgactacccccacagagtggccaagttccccgagaacagaaacagaaacagatacagagacgtgagcccctacgaccacagcagagtgaagctgcagaacgccgagaacgactacatcaacgccagcctggtggacatcgaggaggcccagagaagctacatcctgacccagggccccctgcccaacacctgctgccacttctggctgatggtgtggcagcagaagaccaaggccgtggtgatgctgaacagaatcgtggagaaggagagcgtgaagtgcgcccagtactggcccaccgacgaccaggagatgctgttcaaggagaccggcttcagcgtgaagctgctgagcgaggacgtgaagagctactacaccgtgcacctgctgcagctggagaacatcaacagcggcgagaccagaaccatcagccacttccactacaccacctggcccgacttcggcgtgcccgagagccccgccagcttcctgaacttcctgttcaaggtgagagagagcggcagcctgaaccccgaccacggccccgccgtgatccactgcagcgccggcatcggcagaagcggcaccttcagcctggtggacacctgcctggtgctgatggagaagggcgacgacatcaacatcaagcaggtgctgctgaacatgagaaagtacagaatgggcctgatccagacccccgaccagctgagattcagctacatggccatcatcgagggcgccaagtgcatcaagggcgacagcagcatccagaagagatggaaggagctgagcaaggaggacctgagccccgccttcgaccacagccccaacaagatcatgaccgagaagtacaacggcaacagaatcggcctggaggaggagaagctgaccggcgacagatgcaccggcctgagcagcaagatgcaggacaccatggaggagaacagcgagagcgccctgagaaagagaatcagagaggacagaaaggccaccaccgcccagaaggtgcagcagatgaagcagagactgaacgagaacgagagaaagagaaagagatggctgtactggcagcccatcctgaccaagatgggcttcatgagcgtgatcctggtgggcgccttcgtgggctggaccctgttcttccagcagaacgccctgtag

SEQ ID NO: 95475 - DNA, 1164 bp, Artificial Sequence
  Description of Artificial Sequence: Synthetic coding sequence
atgcccaccaccatcgagagagagttcgaggagctggacacccagagaagatggcagcccctgtacctggagatcagaaacgagagccacgactacccccacagagtggccaagttccccgagaacagaaacagaaacagatacagagacgtgagcccctacgaccacagcagagtgaagctgcagaacgccgagaacgactacatcaacgccagcctggtggacatcgaggaggcccagagaagctacatcctgacccagggccccctgcccaacacctgctgccacttctggctgatggtgtggcagcagaagaccaaggccgtggtgatgctgaacagaatcgtggagaaggagagcgtgaagtgcgcccagtactggcccaccgacgaccaggagatgctgttcaaggagaccggcttcagcgtgaagctgctgagcgaggacgtgaagagctactacaccgtgcacctgctgcagctggagaacatcaacagcggcgagaccagaaccatcagccacttccactacaccacctggcccgacttcggcgtgcccgagagccccgccagcttcctgaacttcctgttcaaggtgagagagagcggcagcctgaaccccgaccacggccccgccgtgatccactgcagcgccggcatcggcagaagcggcaccttcagcctggtggacacctgcctggtgctgatggagaagggcgacgacatcaacatcaagcaggtgctgctgaacatgagaaagtacagaatgggcctgatccagacccccgaccagctgagattcagctacatggccatcatcgagggcgccaagtgcatcaagggcgacagcagcatccagaagagatggaaggagctgagcaaggaggacctgagccccgccttcgaccacagccccaacaagatcatgaccgagaagtacaacggcaacagaatcggcctggaggaggagaagctgaccggcgacagatgcaccggcctgagcagcaagatgcaggacaccatggaggagaacagcgagagcgccctgagaaagagaatcagagaggacagaaaggccaccaccgcccagaaggtgcagcagatgaagcagagactgaacgagaacgagagaaagagaaagagacccagactgaccgacacctag

SEQ ID NO: 95476 - DNA, 1179 bp, Artificial Sequence
  Description of Artificial Sequence: Synthetic coding sequence
tgccagcaggagttcagaatgtacggcaaggacggcaagggcaccaactggatggaccagggcgacatggagtgcagaatgcaggagatcgacgaccacagcagagtgaagctgcagaacgccgagaacgactacatcaacgccagcctggtggacatcgaggaggcccagagaagctacatcctgacccagggccccctgcccaacacctgctgccacttctggctgatggtgtggcagcagaagaccaaggccgtggtgatgctgaacagaatcgtggagaaggagagcgtgaagtgcgcccagtactggcccaccgacgaccaggagatgctgttcaaggagaccggcttcagcgtgaagctgctgagcgaggacgtgaagagctactacaccgtgcacctgctgcagctggagaacatcaacagcggcgagaccagaaccatcagccacttccactacaccacctggcccgacttcggcgtgcccgagagccccgccagcttcctgaacttcctgttcaaggtgagagagagcggcagcctgaaccccgaccacggccccgccgtgatccactgcagcgccggcatcggcagaagcggcaccttcagcctggtggacacctgcctggtgctgatggagaagggcgacgacatcaacatcaagcaggtgctgctgaacatgagaaagtacagaatgggcctgatccagacccccgaccagctgagattcagctacatggccatcatcgagggcgccaagtgcatcaagggcgacagcagcatccagaagagatggaaggagctgagcaaggaggacctgagccccgccttcgaccacagccccaacaagatcatgaccgagaagtacaacggcaacagaatcggcctggaggaggagaagctgaccggcgacagatgcaccggcctgagcagcaagatgcaggacaccatggaggagaacagcgagagcgccctgagaaagagaatcagagaggacagaaaggccaccaccgcccagaaggtgcagcagatgaagcagagactgaacgagaacgagagaaagagaaagagatggctgtactggcagcccatcctgaccaagatgggcttcatgagcgtgatcctggtgggcgccttcgtgggctggaccctgttcttccagcagaacgccctgtag

SEQ ID NO: 95477 - DNA, 1062 bp, Artificial Sequence
  Description of Artificial Sequence: Synthetic coding sequence
atgcccaccaccatcgagagagagttcgaggagctggacacccagagaagatggcagcccctgtacctggagatcagaaacgagagccacgactacccccacagagtggccaagttccccgagaacagaaacagaaacagatacagagacgtgagcccctacgaccacagcagagtgaagctgcagaacgccgagaacgactacatcaacgccagcctggtggacatcgaggaggcccagagaagctacatcctgacccagggccccctgcccaacacctgctgccacttctggctgatggtgtggcagcagaagaccaaggccgtggtgatgctgaacagaatcgtggagaaggagagcgtgaagtgcgcccagtactggcccaccgacgaccaggagatgctgttcaaggagaccggcttcagcgtgaagctgctgagcgaggacgtgaagagctactacaccgtgcacctgctgcagctggagaacatcaacagcggcgagaccagaaccatcagccacttccactacaccacctggcccgacttcggcgtgcccgagagccccgccagcttcctgaacttcctgttcaaggtgagagagagcggcagcctgaaccccgaccacggccccgccgtgatccactgcagcgccggcatcggcagaagcggcaccttcagcctggtggacacctgcctggtgctgatggagaagggcgacgacatcaacatcaagcaggtgctgctgaacatgagaaagtacagaatgggcctgatccagacccccgaccagctgagattcagctacatggccatcatcgagggcgccaagtgcatcaagggcgacagcagcatccagaagagatggaaggagctgagcaaggaggacctgagccccgccttcgaccacagccccaacaagatcatgaccgagaagtacaacggcaacagaatcggcctggaggaggagaagctgaccggcgacagatgcaccggcctgagcagcaagatgcaggacaccatggaggagaacagcgagagacccagactgaccgacacctag

SEQ ID NO: 95478 - DNA, 2424 bp, Artificial Sequence
  Description of Artificial Sequence: Synthetic coding sequence
atggaccagagagagatcctgcagaagttcctggacgaggcccagagcaagaagatcaccaaggaggagttcgccaacgagttcctgaagctgaagagacagagcaccaagtacaaggccgacaagacctaccccaccaccgtggccgagaagcccaagaacatcaagaagaacagatacaaggacatcctgccctacgactacagcagagtggagctgagcctgatcaccagcgacgaggacagcagctacatcaacgccaacttcatcaagggcgtgtacggccccaaggcctacatcgccacccagggccccctgagcaccaccctgctggacttctggagaatgatctgggagtacagcgtgctgatcatcgtgatggcctgcatggagtacgagatgggcaagaagaagtgcgagagatactgggccgagcccggcgagatgcagctggagttcggccccttcagcgtgagctgcgaggccgagaagagaaagagcgactacatcatcagaaccctgaaggtgaagttcaacagcgagaccagaaccatctaccagttccactacaagaactggcccgaccacgacgtgcccagcagcatcgaccccatcctggagctgatctgggacgtgagatgctaccaggaggacgacagcgtgcccatctgcatccactgcagcgccggctgcggcagaaccggcgtgatctgcgccatcgactacacctggatgctgctgaaggacggcatcatccccgagaacttcagcgtgttcagcctgatcagagagatgagaacccagagacccagcctggtgcagacccaggagcagtacgagctggtgtacaacgccgtgctggagctgttcaagagacagatggacgtgatcagagacaagcacagcggcaccgagagccaggccaagcactgcatccccgagaagaaccacaccctgcaggccgacagctacagccccaacctgcccaagagcaccaccaaggccgccaagatgatgaaccagcagagaaccaagatggagatcaaggagagcagcagcttcgacttcagaaccagcgagatcagcgccaaggaggagctggtgctgcaccccgccaagagcagcaccagcttcgacttcctggagctgaactacagcttcgacaagaacgccgacaccaccatgaagtggcagaccaaggccttccccatcgtgggcgagcccctgcagaagcaccagagcctggacctgggcagcctgctgttcgagggctgcagcaacagcaagcccgtgaacgccgccggcagatacttcaacagcaaggtgcccatcaccagaaccaagagcacccccttcgagctgatccagcagagagagaccaaggaggtggacagcaaggagaacttcagctacctggagagccagccccacgacagctgcttcgtggagatgcaggcccagaaggtgatgcacgtgagcagcgccgagctgaactacagcctgccctacgacagcaagcaccagatcagaaacgccagcaacgtgaagcaccacgacagcagcgccctgggcgtgtacagctacatccccctggtggagaacccctacttcagcagctggccccccagcggcaccagcagcaagatgagcctggacctgcccgagaagcaggacggcaccgtgttccccagcagcctgctgcccaccagcagcaccagcctgttcagctactacaacagccacgacagcctgagcctgaacagccccaccaacatcagcagcctgctgaaccaggagagcgccgtgctggccaccgcccccagaatcgacgacgagatccccccccccctgcccgtgtggacccccgagagcttcatcgtggtggaggaggccggcgagttcagccccaacgtgcccaagagcctgagcagcgccgtgaaggtgaagatcggcaccagcctggagtggggcggcaccagcgagcccaagaagttcgacgacagcgtgatcctgagacccagcaagagcgtgaagctgagaagccccaagagcgagctgcaccaggacagaagcagcccccccccccccctgcccgagagaaccctggagagcttcttcctggccgacgaggactgcatgcaggcccagagcatcgagacctacagcaccagctaccccgacaccatggagaacagcaccagcagcaagcagaccctgaagacccccggcaagagcttcaccagaagcaagagcctgaagatcctgagaaacatgaagaagagcatctgcaacagctgcccccccaacaagcccgccgagagcgtgcagagcaacaacagcagcagcttcctgaacttcggcttcgccaacagattcagcaagcccaagggccccagaaaccccccccccacctggaacatctag

SEQ ID NO: 95479 - DNA, 1692 bp, Artificial Sequence
  Description of Artificial Sequence: Synthetic coding sequence
atgctgctgaaggacggcatcatccccgagaacttcagcgtgttcagcctgatcagagagatgagaacccagagacccagcctggtgcagacccaggagcagtacgagctggtgtacaacgccgtgctggagctgttcaagagacagatggacgtgatcagagacaagcacagcggcaccgagagccaggccaagcactgcatccccgagaagaaccacaccctgcaggccgacagctacagccccaacctgcccaagagcaccaccaaggccgccaagatgatgaaccagcagagaaccaagatggagatcaaggagagcagcagcttcgacttcagaaccagcgagatcagcgccaaggaggagctggtgctgcaccccgccaagagcagcaccagcttcgacttcctggagctgaactacagcttcgacaagaacgccgacaccaccatgaagtggcagaccaaggccttccccatcgtgggcgagcccctgcagaagcaccagagcctggacctgggcagcctgctgttcgagggctgcagcaacagcaagcccgtgaacgccgccggcagatacttcaacagcaaggtgcccatcaccagaaccaagagcacccccttcgagctgatccagcagagagagaccaaggaggtggacagcaaggagaacttcagctacctggagagccagccccacgacagctgcttcgtggagatgcaggcccagaaggtgatgcacgtgagcagcgccgagctgaactacagcctgccctacgacagcaagcaccagatcagaaacgccagcaacgtgaagcaccacgacagcagcgccctgggcgtgtacagctacatccccctggtggagaacccctacttcagcagctggccccccagcggcaccagcagcaagatgagcctggacctgcccgagaagcaggacggcaccgtgttccccagcagcctgctgcccaccagcagcaccagcctgttcagctactacaacagccacgacagcctgagcctgaacagccccaccaacatcagcagcctgctgaaccaggagagcgccgtgctggccaccgcccccagaatcgacgacgagatccccccccccctgcccgtgtggacccccgagagcttcatcgtggtggaggaggccggcgagttcagccccaacgtgcccaagagcctgagcagcgccgtgaaggtgaagatcggcaccagcctggagtggggcggcaccagcgagcccaagaagttcgacgacagcgtgatcctgagacccagcaagagcgtgaagctgagaagccccaagagcgagctgcaccaggacagaagcagcccccccccccccctgcccgagagaaccctggagagcttcttcctggccgacgaggactgcatgcaggcccagagcatcgagacctacagcaccagctaccccgacaccatggagaacagcaccagcagcaagcagaccctgaagacccccggcaagagcttcaccagaagcaagagcctgaagatcctgagaaacatgaagaagagcatctgcaacagctgcccccccaacaagcccgccgagagcgtgcagagcaacaacagcagcagcttcctgaacttcggcttcgccaacagattcagcaagcccaagggccccagaaaccccccccccacctggaacatctag

SEQ ID NO: 95480 - DNA, 4911 bp, Artificial Sequence
  Description of Artificial Sequence: Synthetic coding sequence
atggaggccgtgcccagaatgcccatgatctggctggacctgaaggaggccggcgacttccacttccagcccgccgtgaagaagttcgtgctgaagaactacggcgagaaccccgaggcctacaacgaggagctgaagaagctggagctgctgagacagaacgccgtgagagtgcccagagacttcgagggctgcagcgtgctgagaaagtacctgggccagctgcactacctgcagagcagagtgcccatgggcagcggccaggaggccgccgtgcccgtgacctggaccgagatcttcagcggcaagagcgtggcccacgaggacatcaagtacgagcaggcctgcatcctgtacaacctgggcgccctgcacagcatgctgggcgccatggacaagagagtgagcgaggagggcatgaaggtgagctgcacccacttccagtgcgccgccggcgccttcgcctacctgagagagcacttcccccaggcctacagcgtggacatgagcagacagatcctgaccctgaacgtgaacctgatgctgggccaggcccaggagtgcctgctggagaagagcatgctggacaacagaaagagcttcctggtggccagaatcagcgcccaggtggtggactactacaaggaggcctgcagagccctggagaaccccgacaccgccagcctgctgggcagaatccagaaggactggaagaagctggtgcagatgaagatctactacttcgccgccgtggcccacctgcacatgggcaagcaggccgaggagcagcagaagttcggcgagagagtggcctacttccagagcgccctggacaagctgaacgaggccatcaagctggccaagggccagcccgacaccgtgcaggacgccctgagattcaccatggacgtgatcggcggcaagtacaacagcgccaagaaggacaacgacttcatctaccacgaggccgtgcccgccctggacaccctgcagcccgtgaagggcgcccccctggtgaagcccctgcccgtgaaccccaccgaccccgccgtgaccggccccgacatcttcgccaagctggtgcccatggccgcccacgaggccagcagcctgtacagcgaggagaaggccaagctgctgagagagatgatggccaagatcgaggacaagaacgaggtgctggaccagttcatggacagcatgcagctggaccccgagaccgtggacaacctggacgcctacagccacatccccccccagctgatggagaagtgcgccgccctgagcgtgagacccgacaccgtgagaaacctggtgcagagcatgcaggtgctgagcggcgtgttcaccgacgtggaggccagcctgaaggacatcagagacctgctggaggaggacgagctgctggagcagaagttccaggaggccgtgggccaggccggcgccatcagcatcaccagcaaggccgagctggccgaggtgagaagagagtgggccaagtacatggaggtgcacgagaaggccagcttcaccaacagcgagctgcacagagccatgaacctgcacgtgggcaacctgagactgctgagcggccccctggaccaggtgagagccgccctgcccacccccgccctgagccccgaggacaaggccgtgctgcagaacctgaagagaatcctggccaaggtgcaggagatgagagaccagagagtgagcctggagcagcagctgagagagctgatccagaaggacgacatcaccgccagcctggtgaccaccgaccacagcgagatgaagaagctgttcgaggagcagctgaagaagtacgaccagctgaaggtgtacctggagcagaacctggccgcccaggacagagtgctgtgcgccctgaccgaggccaacgtgcagtacgccgccgtgagaagagtgctgagcgacctggaccagaagtggaacagcaccctgcagaccctggtggccagctacgaggcctacgaggacctgatgaagaagagccaggagggcagagacttctacgccgacctggagagcaaggtggccgccctgctggagagaacccagagcacctgccaggccagagaggccgccagacagcagctgctggacagagagctgaagaagaagcccccccccagacccaccgcccccaagcccctgctgcccagaagagaggagagcgaggccgtggaggccggcgacccccccgaggagctgagaagcctgccccccgacatggtggccggccccagactgcccgacaccttcctgggcagcgccacccccctgcacttcccccccagccccttccccagcagcaccggccccggcccccactacctgagcggccccctgccccccggcacctacagcggccccacccagctgatccagcccagagcccccggcccccacgccatgcccgtggcccccggccccgccctgtaccccgcccccgcctacacccccgagctgggcctggtgcccagaagcagcccccagcacggcgtggtgagcagcccctacgtgggcgtgggccccgccccccccgtggccggcctgcccagcgccccccccccccagttcagcggccccgagctggccatggccgtgagacccgccaccaccaccgtggacagcatccaggcccccatccccagccacaccgcccccagacccaaccccacccccgcccccccccccccctgcttccccgtgccccccccccagcccctgcccaccccctacacctaccccgccggcgccaagcagcccatccccgcccagcaccacttcagcagcggcatccccgccggcttccccgcccccagaatcggcccccagccccagccccacccccagccccaccccagccaggccttcggcccccagcccccccagcagcccctgcccctgcagcacccccacctgttccccccccaggcccccggcctgctgcccccccagagcccctacccctacgccccccagcccggcgtgctgggccagccccccccccccctgcacacccagctgtaccccggccccgcccaggaccccctgcccgcccacagcggcgccctgcccttccccagccccggccccccccagcccccccacccccccctggcctacggccccgcccccagcaccagacccatgggcccccaggccgcccccctgaccatcagaggccccagcagcgccggccagagcacccccagcccccacctggtgcccagccccgcccccagccccggccccggccccgtgccccccagaccccccgccgccgagccccccccctgcctgagaagaggcgccgccgccgccgacctgctgagcagcagccccgagagccagcacggcggcacccagagccccggcggcggccagcccctgctgcagcccaccaaggtggacgccgccgagggcagaagaccccaggccctgagactgatcgagagagacccctacgagcaccccgagagactgagacagctgcagcaggagctggaggccttcagaggccagctgggcgacgtgggcgccctggacaccgtgtggagagagctgcaggacgcccaggagcacgacgccagaggcagaagcatcgccatcgccagatgctacagcctgaagaacagacaccaggacgtgatgccctacgacagcaacagagtggtgctgagaagcggcaaggacgactacatcaacgccagctgcgtggagggcctgagcccctactgcccccccctggtggccacccaggcccccctgcccggcaccgccgccgacttctggctgatggtgcacgagcagaaggtgagcgtgatcgtgatgctggtgagcgaggccgagatggagaagcagaaggtggccagatacttccccaccgagagaggccagcccatggtgcacggcgccctgagcctggccctgagcagcgtgagaagcaccgagacccacgtggagagagtgctgagcctgcagttcagagaccagagcctgaagagaagcctggtgcacctgcacttccccacctggcccgagctgggcctgcccgacagccccagcaacctgctgagattcatccaggaggtgcacgcccactacctgcaccagagacccctgcacacccccatcatcgtgcactgcagcagcggcgtgggcagaaccggcgccttcgccctgctgtacgccgccgtgcaggaggtggaggccggcaacggcatccccgagctgccccagctggtgagaagaatgagacagcagagaaagcacatgctgcaggagaagctgcacctgagattctgctacgaggccgtggtgagacacgtggagcaggtgctgcagagacacggcgtgccccccccctgcaagcccctggccagcgccagcatcagccagaagaaccacctgccccaggacagccaggacctggtgctgggcggcgacgtgcccatcagcagcatccaggccaccatcgccaagctgagcatcagaccccccggcggcctggagagccccgtggccagcctgcccggccccgccgagccccccggcctgccccccgccagcctgcccgagagcacccccatccccagcagcagccccccccccctgagcagccccctgcccgaggccccccagcccaaggaggagccccccgtgcccgaggcccccagcagcggcccccccagcagcagcctggagctgctggccagcctgacccccgaggccttcagcctggacagcagcctgagaggcaagcagagaatgagcaagcacaacttcctgcaggcccacaacggccagggcctgagagccaccagacccagcgacgaccccctgagcctgctggaccccctgtggaccctgaacaagacctag

SEQ ID NO: 95481 - DNA, 2739 bp, Artificial Sequence
  Description of Artificial Sequence: Synthetic coding sequence
atggaggccgtgcccagaatgcccatgatctggctggacctgaaggaggccggcgacttccacttccagcccgccgtgaagaagaacgccgtgagagtgcccagagacttcgagggctgcagcgtgctgagaaagtacctgggccagctgcactacctgcagagcagagtgcccatgggcagcggccaggaggccgccgtgcccgtgacctggaccgagatcttcagcggcaagagcgtggcccacgaggacatcaagtacgagcaggcctgcatcctgtacaacctgggcgccctgcacagcatgctgggcgccatggacaagagagtgagcgaggagtgcgccgccggcgccttcgcctacctgagagagcacttcccccaggcctacagcgtggacatgagcagacagatcctgaccctgaacgtgaacctgatgctgggccaggcccaggagtgcctgctggagaagagcatgctggacaacagaaagagcttcctggtggccagaatcagcgcccaggtggtggactactacaaggaggcctgcagagccctggagaaccccgacaccgccagcctgctgggcagaatccagaaggactggaagaagctggtgcagatgaagatctactacttcgccgccgtggcccacctgcacatgggcaagcaggccgaggagcagcagaagttcggcgagagagtggcctacttccagagcgccctggacaagctgaacgaggccatcaagctggccaagggccagcccgacaccgtgcaggacgccctgagattcaccatggacgtgatcggcggcaagtacaacagcgccaagaaggacaacgacttcatctaccacgaggccgtgcccgccctggacaccctgcagcccgtgaagggcgcccccctggtgaagcccctgcccgtgaaccccaccgaccccgccgtgaccggccccgacatcttcgccaagctggtgcccatggccgcccacgaggccagcagcctgtacagcgaggagaaggccaagctgctgagagagatgatggccaagatcgaggacaagaacgaggtgctggaccagttcatggacagcatgcagctggaccccgagaccgtggacaacctggacgcctacagccacatccccccccagctgatggagaagtgcgccgccctgagcgtgagacccgacaccgtgagaaacctggtgcagagcatgcaggtgctgagcggcgtgttcaccgacgtggaggccagcctgaaggacatcagagacctgctggaggaggacgagctgctggagcagaagttccaggaggccgtgggccaggccggcgccatcagcatcaccagcaaggccgagctggccgaggtgagaagagagtgggccaagtacatggaggtgcacgagaaggccagcttcaccaacagcgagctgcacagagccatgaacctgcacgtgggcaacctgagactgctgagcggccccctggaccaggtgagagccgccctgcccacccccgccctgagccccgaggacaaggccgtgctgcagaacctgaagagaatcctggccaaggtgcaggagatgagagaccagagagtgagcctggagcagcagctgagagagctgatccagaaggacgacatcaccgccagcctggtgaccaccgaccacagcgagatgaagaagctgttcgaggagcagctgaagaagtacgaccagctgaaggtgtacctggagcagaacctggccgcccaggacagagtgctgtgcgccctgaccgaggccaacgtgcagtacgccgccgtgagaagagtgctgagcgacctggaccagaagtggaacagcaccctgcagaccctggtggccagctacgaggcctacgaggacctgatgaagaagagccaggagggcagagacttctacgccgacctggagagcaaggtggccgccctgctggagagaacccagagcacctgccaggccagagaggccgccagacagcagctgctggacagagagctgaagaagaagcccccccccagacccaccgcccccaagcccctgctgcccagaagagaggagagcgaggccgtggaggccggcgacccccccgaggagctgagaagcctgccccccgacatggtggccggccccagactgcccgacaccttcctgggcagcgccacccccctgcacttcccccccagccccttccccagcagcaccggccccggcccccactacctgagcggccccctgccccccggcacctacagcggccccacccagctgatccagcccagagcccccggcccccacgccatgcccgtggcccccggccccgccctgtaccccgcccccagcagcgcccccagcttcaccagcgtgtgggccagcgcccccaccgccgcccccagcacccccgccagcaccagcctgcccacccccggccccagaacccccacccccaccatccccctgcccctgtgccccagcgcctggggccccggcgccgccgccaccccccccacccaccccgccctgcccagaagcagaagcagacccagcgccagccccctgagaggcagcgccttcccccagccctgggcccccagcgccagccccagccccaccggcatctggagctgccccttctaccagacccacggcccccccggcagccccagctaccacagcagagccctggtgtgctggcccgtgcacccctag

SEQ ID NO: 95482 - DNA, 1698 bp, Artificial Sequence
  Description of Artificial Sequence: Synthetic coding sequence
atgaactacgagggcgccagaagcgagagagagaaccacgccgccgacgacagcgagggcggcgccctggacatgtgctgcagcgagagactgcccggcctgccccagcccatcgtgatggaggccctggacgaggccgagggcctgcaggacagccagagagagatgccccccccccccccccccagcccccccagcgaccccgcccagaagcccccccccagaggcgccggcagccacagcctgaccgtgagaagcagcctgtgcctgttcgccgccagccagttcctgctggcctgcggcgtgctgtggttcagcggctacggccacatctggagccagaacgccaccaacctggtgagcagcctgctgaccctgctgaagcagctggagcccaccgcctggctggacagcggcacctggggcgtgcccagcctgctgctggtgttcctgagcgtgggcctggtgctggtgaccaccctggtgtggcacctgctgagaaccccccccgagccccccacccccctgccccccgaggacagaagacagagcgtgagcagacagcccagcttcacctacagcgagtggatggaggagaagatcgaggacgacttcctggacctggaccccgtgcccgagacccccgtgttcgactgcgtgatggacatcaagcccgaggccgaccccaccagcctgaccgtgaagagcatgggcctgcaggagagaagaggcagcaacgtgagcctgaccctggacatgtgcacccccggctgcaacgaggagggcttcggctacctgatgagccccagagaggagagcgccagagagtacctgctgagcgccagcagagtgctgcaggccgaggagctgcacgagaaggccctggaccccttcctgctgcaggccgagttcttcgagatccccatgaacttcgtggaccccaaggagtacgacatccccggcctggtgagaaagaacagatacaagaccatcctgcccaacccccacagcagagtgtgcctgaccagccccgaccccgacgaccccctgagcagctacatcaacgccaactacatcagaggctacggcggcgaggagaaggtgtacatcgccacccagggccccatcgtgagcaccgtggccgacttctggagaatggtgtggcaggagcacacccccatcatcgtgatgatcaccaacatcgaggagatgaacgagaagtgcaccgagtactggcccgaggagcaggtggcctacgacggcgtggagatcaccgtgcagaaggtgatccacaccgaggactacagactgagactgatcagcctgaagagcggcaccgaggagagaggcctgaagcactactggttcaccagctggcccgaccagaagacccccgacagagccccccccctgctgcacctggtgagagaggtggaggaggccgcccagcaggagggcccccactgcgcccccatcatcgtgcactgcagcgccggcatcggcagaaccggctgcttcatcgccaccagcatctgctgccagcagctgagacaggagggcgtggtggacatcctgaagaccacctgccagctgagacaggacagaggcggcatgatccagacctgcgagcagtaccagttcgtgcaccacgtgatgagcctgtacgagaagcagctgagccaccagagccccgagtag

SEQ ID NO: 95483 - DNA, 1602 bp, Artificial Sequence
  Description of Artificial Sequence: Synthetic coding sequence
atgaactacgagggcgccagaagcgagagagagaaccacgccgccgacgacagcgagggcggcgccctggacatgtgctgcagcgagagactgcccggcctgccccagcccatcgtgatggaggccctggacgaggccgagggcctgcaggacagccagagagagatgccccccccccccccccccagcccccccagcgaccccgcccagaagcccccccccagaggcgccggcagccacagcctgaccgtgagaagcagcctgtgcctgttcgccgccagccagttcctgctggagcccaccgcctggctggacagcggcacctggggcgtgcccagcctgctgctggtgttcctgagcgtgggcctggtgctggtgaccaccctggtgtggcacctgctgagaaccccccccgagccccccacccccctgccccccgaggacagaagacagagcgtgagcagacagcccagcttcacctacagcgagtggatggaggagaagatcgaggacgacttcctggacctggaccccgtgcccgagacccccgtgttcgactgcgtgatggacatcaagcccgaggccgaccccaccagcctgaccgtgaagagcatgggcctgcaggagagaagaggcagcaacgtgagcctgaccctggacatgtgcacccccggctgcaacgaggagggcttcggctacctgatgagccccagagaggagagcgccagagagtacctgctgagcgccagcagagtgctgcaggccgaggagctgcacgagaaggccctggaccccttcctgctgcaggccgagttcttcgagatccccatgaacttcgtggaccccaaggagtacgacatccccggcctggtgagaaagaacagatacaagaccatcctgcccaacccccacagcagagtgtgcctgaccagccccgaccccgacgaccccctgagcagctacatcaacgccaactacatcagaggctacggcggcgaggagaaggtgtacatcgccacccagggccccatcgtgagcaccgtggccgacttctggagaatggtgtggcaggagcacacccccatcatcgtgatgatcaccaacatcgaggagatgaacgagaagtgcaccgagtactggcccgaggagcaggtggcctacgacggcgtggagatcaccgtgcagaaggtgatccacaccgaggactacagactgagactgatcagcctgaagagcggcaccgaggagagaggcctgaagcactactggttcaccagctggcccgaccagaagacccccgacagagccccccccctgctgcacctggtgagagaggtggaggaggccgcccagcaggagggcccccactgcgcccccatcatcgtgcactgcagcgccggcatcggcagaaccggctgcttcatcgccaccagcatctgctgccagcagctgagacaggagggcgtggtggacatcctgaagaccacctgccagctgagacaggacagaggcggcatgatccagacctgcgagcagtaccagttcgtgcaccacgtgatgagcctgtacgagaagcagctgagccaccagagccccgagtag

SEQ ID NO: 95484 - DNA, 1698 bp, Artificial Sequence; identical to SEQ ID NO: 95482
  Description of Artificial Sequence: Synthetic coding sequence

SEQ ID NO: 95485 - DNA, 1788 bp, Artificial Sequence
  Description of Artificial Sequence: Synthetic coding sequence
atggtgagatggttccacagagacctgagcggcctggacgccgagaccctgctgaagggcagaggcgtgcacggcagcttcctggccagacccagcagaaagaaccagggcgacttcagcctgagcgtgagagtgggcgaccaggtgacccacatcagaatccagaacagcggcgacttctacgacctgtacggcggcgagaagttcgccaccctgaccgagctggtggagtactacacccagcagcagggcgtgctgcaggacagagacggcaccatcatccacctgaagtaccccctgaactgcagcgaccccaccagcgagagatggtaccacggccacatgagcggcggccaggccgagaccctgctgcaggccaagggcgagccctggaccttcctggtgagagagagcctgagccagcccggcgacttcgtgctgagcgtgctgagcgaccagcccaaggccggccccggcagccccctgagagtgacccacatcaaggtgatgtgcgagggcggcagatacaccgtgggcggcctggagaccttcgacagcctgaccgacctggtggagcacttcaagaagaccggcatcgaggaggccagcggcgccttcgtgtacctgagacagccctactacgccaccagagtgaacgccgccgacatcgagaacagagtgctggagctgaacaagaagcaggagagcgaggacaccgccaaggccggcttctgggaggagttcgagagcctgcagaagcaggaggtgaagaacctgcaccagagactggagggccagagacccgagaacaagggcaagaacagatacaagaacatcctgcccttcgaccacagcagagtgatcctgcagggcagagacagcaacatccccggcagcgactacatcaacgccaactacatcaagaaccagctgctgggccccgacgagaacgccaagacctacatcgccagccagggctgcctggaggccaccgtgaacgacttctggcagatggcctggcaggagaacagcagagtgatcgtgatgaccaccagagaggtggagaagggcagaaacaagtgcgtgccctactggcccgaggtgggcatgcagagagcctacggcccctacagcgtgaccaactgcggcgagcacgacaccaccgagtacaagctgagaaccctgcaggtgagccccctggacaacggcgacctgatcagagagatctggcactaccagtacctgagctggcccgaccacggcgtgcccagcgagcccggcggcgtgctgagcttcctggaccagatcaaccagagacaggagagcctgccccacgccggccccatcatcgtgcactgcagcgccggcatcggcagaaccggcaccatcatcgtgatcgacatgctgatggagaacatcagcaccaagggcctggactgcgacatcgacatccagaagaccatccagatggtgagagcccagagaagcggcatggtgcagaccgaggcccagtacaagttcatctacgtggccatcgcccagttcatcgagaccaccaagaagaagctggaggtgctgcagagccagaagggccaggagagcgagtacggcaacatcacctacccccccgccatgaagaacgcccacgccaaggccagcagaaccagcagcaagcacaaggaggacgtgtacgagaacctgcacaccaagaacaagagagaggagaaggtgaagaagcagagaagcgccgacaaggagaagagcaagggcagcctgaagagaaagtag

SEQ ID NO: 95486 - DNA, 1794 bp, Artificial Sequence
  Description of Artificial Sequence: Synthetic coding sequence
atgctgagcagaggctggttccacagagacctgagcggcctggacgccgagaccctgctgaagggcagaggcgtgcacggcagcttcctggccagacccagcagaaagaaccagggcgacttcagcctgagcgtgagagtgggcgaccaggtgacccacatcagaatccagaacagcggcgacttctacgacctgtacggcggcgagaagttcgccaccctgaccgagctggtggagtactacacccagcagcagggcgtgctgcaggacagagacggcaccatcatccacctgaagtaccccctgaactgcagcgaccccaccagcgagagatggtaccacggccacatgagcggcggccaggccgagaccctgctgcaggccaagggcgagccctggaccttcctggtgagagagagcctgagccagcccggcgacttcgtgctgagcgtgctgagcgaccagcccaaggccggccccggcagccccctgagagtgacccacatcaaggtgatgtgcgagggcggcagatacaccgtgggcggcctggagaccttcgacagcctgaccgacctggtggagcacttcaagaagaccggcatcgaggaggccagcggcgccttcgtgtacctgagacagccctactacgccaccagagtgaacgccgccgacatcgagaacagagtgctggagctgaacaagaagcaggagagcgaggacaccgccaaggccggcttctgggaggagttcgagagcctgcagaagcaggaggtgaagaacctgcaccagagactggagggccagagacccgagaacaagggcaagaacagatacaagaacatcctgcccttcgaccacagcagagtgatcctgcagggcagagacagcaacatccccggcagcgactacatcaacgccaactacatcaagaaccagctgctgggccccgacgagaacgccaagacctacatcgccagccagggctgcctggaggccaccgtgaacgacttctggcagatggcctggcaggagaacagcagagtgatcgtgatgaccaccagagaggtggagaagggcagaaacaagtgcgtgccctactggcccgaggtgggcatgcagagagcctacggcccctacagcgtgaccaactgcggcgagcacgacaccaccgagtacaagctgagaaccctgcaggtgagccccctggacaacggcgacctgatcagagagatctggcactaccagtacctgagctggcccgaccacggcgtgcccagcgagcccggcggcgtgctgagcttcctggaccagatcaaccagagacaggagagcctgccccacgccggccccatcatcgtgcactgcagcgccggcatcggcagaaccggcaccatcatcgtgatcgacatgctgatggagaacatcagcaccaagggcctggactgcgacatcgacatccagaagaccatccagatggtgagagcccagagaagcggcatggtgcagaccgaggcccagtacaagttcatctacgtggccatcgcccagttcatcgagaccaccaagaagaagctggaggtgctgcagagccagaagggccaggagagcgagtacggcaacatcacctacccccccgccatgaagaacgcccacgccaaggccagcagaaccagcagcaagcacaaggaggacgtgtacgagaacctgcacaccaagaacaagagagaggagaaggtgaagaagcagagaagcgccgacaaggagaagagcaagggcagcctgaagagaaagtag

SEQ ID NO: 95487 - DNA, 1671 bp, Artificial Sequence
  Description of Artificial Sequence: Synthetic coding sequence
atgctgagcagaggcgtgggcgaccaggtgacccacatcagaatccagaacagcggcgacttctacgacctgtacggcggcgagaagttcgccaccctgaccgagctggtggagtactacacccagcagcagggcgtgctgcaggacagagacggcaccatcatccacctgaagtaccccctgaactgcagcgaccccaccagcgagagatggtaccacggccacatgagcggcggccaggccgagaccctgctgcaggccaagggcgagccctggaccttcctggtgagagagagcctgagccagcccggcgacttcgtgctgagcgtgctgagcgaccagcccaaggccggccccggcagccccctgagagtgacccacatcaaggtgatgtgcgagggcggcagatacaccgtgggcggcctggagaccttcgacagcctgaccgacctggtggagcacttcaagaagaccggcatcgaggaggccagcggcgccttcgtgtacctgagacagccctactacgccaccagagtgaacgccgccgacatcgagaacagagtgctggagctgaacaagaagcaggagagcgaggacaccgccaaggccggcttctgggaggagttcgagagcctgcagaagcaggaggtgaagaacctgcaccagagactggagggccagagacccgagaacaagggcaagaacagatacaagaacatcctgcccttcgaccacagcagagtgatcctgcagggcagagacagcaacatccccggcagcgactacatcaacgccaactacatcaagaaccagctgctgggccccgacgagaacgccaagacctacatcgccagccagggctgcctggaggccaccgtgaacgacttctggcagatggcctggcaggagaacagcagagtgatcgtgatgaccaccagagaggtggagaagggcagaaacaagtgcgtgccctactggcccgaggtgggcatgcagagagcctacggcccctacagcgtgaccaactgcggcgagcacgacaccaccgagtacaagctgagaaccctgcaggtgagccccctggacaacggcgacctgatcagagagatctggcactaccagtacctgagctggcccgaccacggcgtgcccagcgagcccggcggcgtgctgagcttcctggaccagatcaaccagagacaggagagcctgccccacgccggccccatcatcgtgcactgcagcgccggcatcggcagaaccggcaccatcatcgtgatcgacatgctgatggagaacatcagcaccaagggcctggactgcgacatcgacatccagaagaccatccagatggtgagagcccagagaagcggcatggtgcagaccgaggcccagtacaagttcatctacgtggccatcgcccagttcatcgagaccaccaagaagaagctggaggtgctgcagagccagaagggccaggagagcgagtacggcaacatcacctacccccccgccatgaagaacgcccacgccaaggccagcagaaccagcagcaagcacaaggaggacgtgtacgagaacctgcacaccaagaacaagagagaggagaaggtgaagaagcagagaagcgccgacaaggagaagagcaagggcagcctgaagagaaagtag

SEQ ID NO: 95488 - DNA, 1875 bp, Artificial Sequence
  Description of Artificial Sequence: Synthetic coding sequence
atggtgagatggttccacagagacctgagcggcctggacgccgagaccctgctgaagggcagaggcgtgcacggcagcttcctggccagacccagcagaaagaaccagggcgacttcagcctgagcgtgagagtgggcgaccaggtgacccacatcagaatccagaacagcggcgacttctacgacctgtacggcggcgagaagttcgccaccctgaccgagctggtggagtactacacccagcagcagggcgtgctgcaggacagagacggcaccatcatccacctgaagtaccccctgaactgcagcgaccccaccagcgagagatggtaccacggccacatgagcggcggccaggccgagaccctgctgcaggccaagggcgagccctggaccttcctggtgagagagagcctgagccagcccggcgacttcgtgctgagcgtgctgagcgaccagcccaaggccggccccggcagccccctgagagtgacccacatcaaggtgatgtgcgagggcggcagatacaccgtgggcggcctggagaccttcgacagcctgaccgacctggtggagcacttcaagaagaccggcatcgaggaggccagcggcgccttcgtgtacctgagacagccctactacgccaccagagtgaacgccgccgacatcgagaacagagtgctggagctgaacaagaagcaggagagcgaggacaccgccaaggccggcttctgggaggagttcgagagcctgcagaagcaggaggtgaagaacctgcaccagagactggagggccagagacccgagaacaagggcaagaacagatacaagaacatcctgcccttcgaccacagcagagtgatcctgcagggcagagacagcaacatccccggcagcgactacatcaacgccaactacatcaagaaccagctgctgggccccgacgagaacgccaagacctacatcgccagccagggctgcctggaggccaccgtgaacgacttctggcagatggcctggcaggagaacagcagagtgatcgtgatgaccaccagagaggtggagaagggcagaaacaagtgcgtgccctactggcccgaggtgggcatgcagagagcctacggcccctacagcgtgaccaactgcggcgagcacgacaccaccgagtacaagctgagaaccctgcaggtgagccccctggacaacggcgacctgatcagagagatctggcactaccagtacctgagctggcccgaccacggcgtgcccagcgagcccggcggcgtgctgagcttcctggaccagatcaaccagagacaggagagcctgccccacgccggccccatcatcgtgcactgcagcgccggcatcggcagaaccggcaccatcatcgtgatcgacatgctgatggagaacatcagcaccaagggcctggactgcgacatcgacatccagaagaccatccagatggtgagagcccagagaagcggcatggtgcagaccgaggcccagtacaagttcatctacgtggccatcgcccagttcatcgagaccaccaagaagaagctggaggtgctgcagagccagaagggccaggagagcgagtacggcaacatcacctacccccccgccatgaagaacgcccacgccaaggccagcagaaccagcagcaagagcctggagagcagcgccggcaccgtggccgccagccccgtgagaagaggcggccagagaggcctgcccgtgcccggcccccccgtgctgagccccgacctgcaccagctgcccgtgctggcccccctgcaccccgccgccgacaccagaagaatgtgcatgagaacctgcaccctgagaaccagaggcagaagaaagtag

SEQ ID NO: 95489 - DNA, 1083 bp, Artificial Sequence
  Description of Artificial Sequence: Synthetic coding sequence
atggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagagcccagagccaggaggacggcgactacatcaacgccaactacatcagaggctacgacggcaaggagaaggtgtacatcgccacccagggccccatgcccaacaccgtgagcgacttctgggagatggtgtggcaggaggaggtgagcctgatcgtgatgctgacccagctgagagagggcaaggagaagtgcgtgcactactggcccaccgaggaggagacctacggccccttccagatcagaatccaggacatgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95490 - DNA, 1398 bp, Artificial Sequence
  Description of Artificial Sequence: Synthetic coding sequence
atggtgggcaaggcctggcccctgacccacagccagggcaccggcccctgggcccccgagggccacagaagagaggccgccgacccctggtggcagagacagcaggcccaggagggcagaatgcagctgggctgcgcctgggtggccgccagaagaggcggcggcagaaagctggccagctggagcctgctgagcccccagagacagaccgacagacagaccgacagctggcaggaggccgcctggggcccccagctgctgcagcagaccagctggctgagcgagccccccctgggccccgccccccacctgagcatggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagagcccagagccaggaggacggcgactacatcaacgccaactacatcagaggctacgacggcaaggagaaggtgtacatcgccacccagggccccatgcccaacaccgtgagcgacttctgggagatggtgtggcaggaggaggtgagcctgatcgtgatgctgacccagctgagagagggcaaggagaagtgcgtgcactactggcccaccgaggaggagacctacggccccttccagatcagaatccaggacatgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95491 - DNA, 1200 bp, Artificial Sequence
  Description of Artificial Sequence: Synthetic coding sequence
atgggcgccagcttctggcccatcagacaggccagagagcagcagagaagagccctgagcttcagacagaccagctggctgagcgagccccccctgggccccgccccccacctgagcatggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagagcccagagccaggaggacggcgactacatcaacgccaactacatcagaggctacgacggcaaggagaaggtgtacatcgccacccagggccccatgcccaacaccgtgagcgacttctgggagatggtgtggcaggaggaggtgagcctgatcgtgatgctgacccagctgagagagggcaaggagaagtgcgtgcactactggcccaccgaggaggagacctacggccccttccagatcagaatccaggacatgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95492 - DNA, 465 bp, Artificial Sequence
  Description of Artificial Sequence: Synthetic coding sequence
atggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagagcccagagccaggaggacggcgactacatcaacgccaactactag

SEQ ID NO: 95493 - DNA, 1326 bp, Artificial Sequence
  Description of Artificial Sequence: Synthetic coding sequence
aagagaagaagagccgccagcatgaacagactgggctgctggcccgccagaagcctgcccagaagcggcagaggcagcggccagagaagcctgggcctgggcggccaccccagcggccccagacaccccggcacccccgccgccaagagaacctgggagagccccggcgtgagagccagagactgccccctgagcaccagctggctgagcgagccccccctgggccccgccccccacctgagcatggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagagcccagagccaggaggacggcgactacatcaacgccaactacatcagaggctacgacggcaaggagaaggtgtacatcgccacccagggccccatgcccaacaccgtgagcgacttctgggagatggtgtggcaggaggaggtgagcctgatcgtgatgctgacccagctgagagagggcaaggagaagtgcgtgcactactggcccaccgaggaggagacctacggccccttccagatcagaatccaggacatgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95494 - DNA, 423 bp, Artificial Sequence
  Description of Artificial Sequence: Synthetic coding sequence
atggtgcaggcccacggcggcagaagcagagcccagcccctgaccctgagcctgggcgccgccatgacccagcccccccccgagaagacccccgccaagaagcacgtgagactgcaggagagaagaggcagcaacgtggccctgatgctggacgtgagaagcctgggcgccgtggagcccatctgcagcgtgaacacccccagagaggtgaccctgcacttcctgagaaccgccggccaccccctgaccagatgggccctgcagagacagccccccagccccaagcagctggaggaggagttcctgaagatccccagcaacttcgtgagccccgaggacctggacatccccggccacgccagcaaggacagatacaagaccatcctgcccaacccccagagcagagtgtgcctgggcagatag

SEQ ID NO: 95495 - DNA, 1083 bp, Artificial Sequence; identical to SEQ ID NO: 95489
  Description of Artificial Sequence: Synthetic coding sequence

SEQ ID NO: 95496 - DNA, 570 bp, Artificial Sequence
  Description of Artificial Sequence: Synthetic coding sequence
atgcccaacaccgtgagcgacttctgggagatggtgtggcaggaggaggtgagcctgatcgtgatgctgacccagctgagagagggcaaggagaagtgcgtgcactactggcccaccgaggaggagacctacggccccttccagatcagaatccaggacatgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95497 - DNA, 411 bp, Artificial Sequence
  Description of Artificial Sequence: Synthetic coding sequence
atgaaggagtgccccgagtacaccgtgagacagctgaccatccagtaccaggaggagagaagaagcgtgaagcacatcctgttcagcgcctggcccgaccaccagacccccgagagcgccggccccctgctgagactggtggccgaggtggaggagagccccgagaccgccgcccaccccggccccatcgtggtgcactgcagcgccggcatcggcagaaccggctgcttcatcgccaccagaatcggctgccagcagctgaaggccagaggcgaggtggacatcctgggcatcgtgtgccagctgagactggacagaggcggcatgatccagaccgccgagcagtaccagttcctgcaccacaccctggccctgtacgccggccagctgcccgaggagcccagcccctag

SEQ ID NO: 95498 - DNA, 1545 bp, Artificial Sequence
  Description of Artificial Sequence: Synthetic coding sequence
atgagcagccccatcagcaagagcagaagcctggccgccttcctgcagcagctgagaagccccagacagccccccagactggtgaccagcaccgcctacaccagcccccagcccagagaggtgcccgtgtgccccctgaccgccggcggcgagacccagaacgccgccgccctgcccggccccaccagctggcccctgctgggcagcctgctgcagatcctgtggaagggcggcctgaagaagcagcacgacaccctggtggagtaccacaagaagtacggcaagatcttcagaatgaagctgggcagcttcgagagcgtgcacctgggcagcccctgcctgctggaggccctgtacagaaccgagagcgcctacccccagagactggagatcaagccctggaaggcctacagagactacagaaaggagggctacggcctgctgatcctggagggcgaggactggcagagagtgagaagcgccttccagaagaagctgatgaagcccggcgaggtgatgaagctggacaacaagatcaacgaggtgctggccgacttcatgggcagaatcgacgagctgtgcgacgagagaggccacgtggaggacctgtacagcgagctgaacaagtggagcttcgagagcatctgcctggtgctgtacgagaagagattcggcctgctgcagaagaacgccggcgacgaggccgtgaacttcatcatggccatcaagaccatgatgagcaccttcggcagaatgatggtgacccccgtggagctgcacaagagcctgaacaccaaggtgtggcaggaccacaccctggcctgggacaccatcttcaagagcgtgaaggcctgcatcgacaacagactggagaagtacagccagcagcccagcgccgacttcctgtgcgacatctaccaccagaacagactgagcaagaaggagctgtacgccgccgtgaccgagctgcagctggccgccgtggagaccaccgccaacagcctgatgtggatcctgtacaacctgagcagaaacccccaggtgcagcagaagctgctgaaggagatccagagcgtgctgcccgagaaccaggtgcccagagccgaggacctgagaaacatgccctacctgaaggcctgcctgaaggagagcatgagactgacccccagcgtgcccttcaccaccagaaccctggacaaggccaccgtgctgggcgagtacgccctgcccaagggcaccgtgctgatgctgaacacccaggtgctgggcagcagcgaggacaacttcgaggacagcagccagttcagacccgagagatggctgcaggagaaggagaagatcaaccccttcgcccacctgcccttcggcgtgggcaagagaatgtgcatcggcagaagactggccgagctgcagctgcacctggccctgtgctggatcgtgagaaagtacgacatccaggccaccgacaacgagcccgtggagatgctgcacagcggcaccctggtgcccagcagagagctgcccatcgccttctgccagagatag

SEQ ID NO: 95499 - DNA, 2382 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcgacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaaggaggagaacaaggagaagaacagatacgtgaacatcctgccctacgaccacagcagagtgcacctgacccccgtggagggcgtgcccgacagcgactacatcaacgccagcttcatcaacggctaccaggagaagaacaagttcatcgccgcccagggccccaaggaggagaccgtgaacgacttctggagaatgatctgggagcagaacaccgccaccatcgtgatggtgaccaacctgaaggagagaaaggagtgcaagtgcgcccagtactggcccgaccagggctgctggacctacggcaacatcagagtgagcgtggaggacgtgaccgtgctggtggactacaccgtgagaaagttctgcatccagcaggtgggcgacatgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 95500 - DNA, 2382 bp, Artificial Sequence; identical to SEQ ID NO: 95499
  Description of Artificial Sequence: Synthetic coding sequence

SEQ ID NO: 95501 - DNA, 1977 bp, Artificial Sequence
  Description of Artificial Sequence: Synthetic coding sequence
atggtggccctgagcagcctgctggtgatcgtgttcatcatcatcgtgctgtacatgctgagaagattcagaaaggccgagctgatgagcagaaacaccgagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaaggaggagaacaaggagaagaacagatacgtgaacatcctgccctacgaccacagcagagtgcacctgacccccgtggagggcgtgcccgacagcgactacatcaacgccagcttcatcaacggctaccaggagaagaacaagttcatcgccgcccagggccccaaggaggagaccgtgaacgacttctggagaatgatctgggagcagaacaccgccaccatcgtgatggtgaccaacctgaaggagagaaaggagtgcaagtgcgcccagtactggcccgaccagggctgctggacctacggcaacatcagagtgagcgtggaggacgtgaccgtgctggtggactacaccgtgagaaagttctgcatccagcaggtgggcgacatgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 95502 - DNA, 2409 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcggcaacagcgacagcaaggacagaagagacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaaggaggagaacaaggagaagaacagatacgtgaacatcctgccctacgaccacagcagagtgcacctgacccccgtggagggcgtgcccgacagcgactacatcaacgccagcttcatcaacggctaccaggagaagaacaagttcatcgccgcccagggccccaaggaggagaccgtgaacgacttctggagaatgatctgggagcagaacaccgccaccatcgtgatggtgaccaacctgaaggagagaaaggagtgcaagtgcgcccagtactggcccgaccagggctgctggacctacggcaacatcagagtgagcgtggaggacgtgaccgtgctggtggactacaccgtgagaaagttctgcatccagcaggtgggcgacatgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 95503 - DNA, 2409 bp, Artificial Sequence; identical to SEQ ID NO: 95502
  Description of Artificial Sequence: Synthetic coding sequence

SEQ ID NO: 95504 - DNA, 603 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcggcaacagcgacagcaaggacagaagagacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtgtag

SEQ ID NO: 95505 - DNA, 2442 bp, Artificial Sequence
  Description of Artificial Sequence: Synthetic coding sequence
atggacgacgccgtgcagatcaccaagatcagcatggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcggcaacagcgacagcaaggacagaagagacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaaggaggagaacaaggagaagaacagatacgtgaacatcctgccctacgaccacagcagagtgcacctgacccccgtggagggcgtgcccgacagcgactacatcaacgccagcttcatcaacggctaccaggagaagaacaagttcatcgccgcccagggccccaaggaggagaccgtgaacgacttctggagaatgatctgggagcagaacaccgccaccatcgtgatggtgaccaacctgaaggagagaaaggagtgcaagtgcgcccagtactggcccgaccagggctgctggacctacggcaacatcagagtgagcgtggaggacgtgaccgtgctggtggactacaccgtgagaaagttctgcatccagcaggtgggcgacatgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 95506 - DNA, 528 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcggcaacagcgacagcaaggacagaagagacgagacccccatcatcgccgtgatggtggccctgagcagcctgctggtgatcgtgttcatcatcatcgtgctgtacatgctgtag

SEQ ID NO: 95507 - DNA, 417 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagctag

SEQ ID NO: 95508 - DNA, 762 bp, Artificial Sequence
  Description of Artificial Sequence: Synthetic coding sequence
atggacagctggttcatcctggtgctgctgggcagcggcctgatctgcgtgagcgccaacaacgccaccaccgtggcccccagcgtgggcatcaccagactgatcaacagcagcaccgccgagcccgtgaaggaggaggccaagaccagcaaccccaccagcagcctgaccagcctgagcgtggcccccaccttcagccccaacatcaccctgggccccacctacctgaccaccgtgaacagcagcgacagcgacaacggcaccaccagaaccgccagcaccaacagcatcggcatcaccatcagccccaacggcacctggctgcccgacaaccagttcaccgacgccagaaccgagccctgggagggcaacagcagcaccgccgccaccacccccgagaccttcccccccagcgacgagacccccatcatcgccgtgatggtggccctgagcagcctgctggtgatcgtgttcatcatcatcgtgctgtacatgctgagattcaagaagtacaagcaggccggcagccacagcaacagcttcagactgagcaacggcagaaccgaggacgtggagccccagagcgtgcccctgctggccagaagccccagcaccaacagaaagtacccccccctgcccgtggacaagctggaggaggagatcaacagaagaatggccgacgacaacaagctgttcagagaggagttcaacgccctgcccgcctgccccatccaggccacctgcgaggccgccagcaagtag

SEQ ID NO: 95509 - DNA, 1239 bp, Artificial Sequence
  Description of Artificial Sequence: Synthetic coding sequence
atgaccaacagaaagccccagagactgatcacccagttccacttcaccagctggcccgacttcggcgtgcccttcacccccatcggcatgctgaagttcctgaagaaggtgaaggcctgcaacccccagtacgccggcgccatcgtggtgcactgcagcgccggcgtgggcagaaccggcaccttcgtggtgatcgacgccatgctggacatgatgcacaccgagagaaaggtggacgtgtacggcttcgtgagcagaatcagagcccagagatgccagatggtgcagaccgacatgcagtacgtgttcatctaccaggccctgctggagcactacctgtacggcgacaccgagctggaggtgaccagcctggagacccacctgcagaagatctacaacaagatccccggcaccagcaacaacggcctggaggaggagttcaagaagctgaccagcatcaagatccagaacgacaagatgagaaccggcaacctgcccgccaacatgaagaagaacagagtgctgcagatcatcccctacgagttcaacagagtgatcatccccgtgaagagaggcgaggagaacaccgactacgtgaacgccagcttcatcgacggctacagacagaaggacagctacatcgccagccagggccccctgctgcacaccatcgaggacttctggagaatgatctgggagtggaagagctgcagcatcgtgatgctgaccgagctggaggagagaggccaggagaagtgcgcccagtactggcccagcgacggcctggtgagctacggcgacatcaccgtggagctgaagaaggaggaggagtgcgagagctacaccgtgagagacctgctggtgaccaacaccagagagaacaagagcagacagatcagacagttccacttccacggctggcccgaggtgggcatccccagcgacggcaagggcatgatcagcatcatcgccgccgtgcagaagcagcagcagcagagcggcaaccaccccatcaccgtgcactgcagcgccggcgccggcagaaccggcaccttctgcgccctgagcaccgtgctggagagagtgaaggccgagggcatcctggacgtgttccagaccgtgaagagcctgagactgcagagaccccacatggtgcagaccctggagcagtacgagttctgctacaaggtggtgcaggagtacatcgacgccttcagcgactacgccaacttcaagtag

SEQ ID NO: 95510 - DNA, 5994 bp, Artificial Sequence
  Description of Artificial Sequence: Synthetic coding sequence
atgctgagccacggcgccggcctggccctgtggatcaccctgagcctgctgcagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccgacaaggtggccaacctggaggccaacaacaacggcagaatgagaagcctggtggtgagctggagcccccccgccggcgactgggagcagtacagaatcctgctgttcaacgacagcgtggtgctgctgaacatcaccgtgggcaaggaggagacccagtacgtgatggacgacaccggcctggtgcccggcagacagtacgaggtggaggtgatcgtggagagcggcaacctgaagaacagcgagagatgccagggcagaaccgtgcccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccagcagcgtgagcggcgtgaccgtgaacaacagcggcagaaacgactacctgagcgtgagctggctgctggcccccggcgacgtggacaactacgaggtgaccctgagccacgacggcaaggtggtgcagagcctggtgatcgccaagagcgtgagagagtgcagcttcagcagcctgacccccggcagactgtacaccgtgaccatcaccaccagaagcggcaagtacgagaaccacagcttcagccaggagagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaagagcatccccaagagcgagaacgagtgcgtgttcgtgcagctggtgcccggcagactgtacagcgtgaccgtgaccaccaagagcggccagtacgaggccaacgagcagggcaacggcagaaccatccccgagcccgtgaaggacctgaccctgagaaacagaagcaccgaggacctgcacgtgacctggagcggcgccaacggcgacgtggaccagtacgagatccagctgctgttcaacgacatgaaggtgttcccccccttccacctggtgaacaccgccaccgagtacagattcaccagcctgacccccggcagacagtacaagatcctggtgctgaccatcagcggcgacgtgcagcagagcgccttcatcgagggcttcaccgtgcccagcgccgtgaagaacatccacatcagccccaacggcgccaccgacagcctgaccgtgaactggacccccggcggcggcgacgtggacagctacaccgtgagcgccttcagacacagccagaaggtggacagccagaccatccccaagcacgtgttcgagcacaccttccacagactggaggccggcgagcagtaccagatcatgatcgccagcgtgagcggcagcctgaagaaccagatcaacgtggtgggcagaaccgtgcccgccagcgtgcagggcgtgatcgccgacaacgcctacagcagctacagcctgatcgtgagctggcagaaggccgccggcgtggccgagagatacgacatcctgctgctgaccgagaacggcatcctgctgagaaacaccagcgagcccgccaccaccaagcagcacaagttcgaggacctgacccccggcaagaagtacaagatccagatcctgaccgtgagcggcggcctgttcagcaaggaggcccagaccgagggcagaaccgtgcccgccgccgtgaccgacctgagaatcaccgagaacagcaccagacacctgagcttcagatggaccgccagcgagggcgagctgagctggtacaacatcttcctgtacaaccccgacggcaacctgcaggagagagcccaggtggaccccctggtgcagagcttcagcttccagaacctgctgcagggcagaatgtacaagatggtgatcgtgacccacagcggcgagctgagcaacgagagcttcatcttcggcagaaccgtgcccgccagcgtgagccacctgagaggcagcaacagaaacaccaccgacagcctgtggttcaactggagccccgccagcggcgacttcgacttctacgagctgatcctgtacaaccccaacggcaccaagaaggagaactggaaggacaaggacctgaccgagtggagattccagggcctggtgcccggcagaaagtacgtgctgtgggtggtgacccacagcggcgacctgagcaacaaggtgaccgccgagagcagaaccgcccccagcccccccagcctgatgagcttcgccgacatcgccaacaccagcctggccatcacctggaagggcccccccgactggaccgactacaacgacttcgagctgcagtggctgcccagagacgccctgaccgtgttcaacccctacaacaacagaaagagcgagggcagaatcgtgtacggcctgagacccggcagaagctaccagttcaacgtgaagaccgtgagcggcgacagctggaagacctacagcaagcccatcttcggcagcgtgagaaccaagcccgacaagatccagaacctgcactgcagaccccagaacagcaccgccatcgcctgcagctggatcccccccgacagcgacttcgacggctacagcatcgagtgcagaaagatggacacccaggaggtggagttcagcagaaagctggagaaggagaagagcctgctgaacatcatgatgctggtgccccacaagagatacctggtgagcatcaaggtgcagagcgccggcatgaccagcgaggtggtggaggacagcaccatcaccatgatcgacagacccccccccccccccccccacatcagagtgaacgagaaggacgtgctgatcagcaagagcagcatcaacttcaccgtgaactgcagctggttcagcgacaccaacggcgccgtgaagtacttcaccgtggtggtgagagaggccgacggcagcgacgagctgaagcccgagcagcagcaccccctgcccagctacctggagtacagacacaacgccagcatcagagtgtaccagaccaactacttcgccagcaagtgcgccgagaaccccaacagcaacagcaagagcttcaacatcaagctgggcgccgagatggagagcctgggcggcaagtgcgaccccacccagcagaagttctgcgacggccccctgaagccccacaccgcctacagaatcagcatcagagccttcacccagctgttcgacgaggacctgaaggagttcaccaagcccctgtacagcgacaccttcttcagcctgcccatcaccaccgagagcgagcccctgttcggcgccatcgagggcgtgagcgccggcctgttcctgatcggcatgctggtggccgtggtggccctgctgatctgcagacagaaggtgagccacggcagagagagacccagcgccagactgagcatcagaagagacagacccctgagcgtgcacctgaacctgggccagaagggcaacagaaagaccagctgccccatcaagatcaaccagttcgagggccacttcatgaagctgcaggccgacagcaactacctgctgagcaaggagtacgaggagctgaaggacgtgggcagaaaccagagctgcgacatcgccctgctgcccgagaacagaggcaagaacagatacaacaacatcctgccctacgacgccaccagagtgaagctgagcaacgtggacgacgacccctgcagcgactacatcaacgccagctacatccccggcaacaacttcagaagagagtacatcgtgacccagggccccctgcccggcaccaaggacgacttctggaagatggtgtgggagcagaacgtgcacaacatcgtgatggtgacccagtgcgtggagaagggcagagtgaagtgcgaccactactggcccgccgaccaggacagcctgtactacggcgacctgatcctgcagatgctgagcgagagcgtgctgcccgagtggaccatcagagagttcaagatctgcggcgaggagcagctggacgcccacagactgatcagacacttccactacaccgtgtggcccgaccacggcgtgcccgagaccacccagagcctgatccagttcgtgagaaccgtgagagactacatcaacagaagccccggcgccggccccaccgtggtgcactgcagcgccggcgtgggcagaaccggcaccttcatcgccctggacagaatcctgcagcagctggacagcaaggacagcgtggacatctacggcgccgtgcacgacctgagactgcacagagtgcacatggtgcagaccgagtgccagtacgtgtacctgcaccagtgcgtgagagacgtgctgagagccagaaagctgagaagcgagcaggagaaccccctgttccccatctacgagaacgtgaaccccgagtaccacagagaccccgtgtacagcagacactag

SEQ ID NO: 95511 - DNA, 6648 bp, Artificial Sequence
  Description of Artificial Sequence: Synthetic coding sequence
atggaggccgagttctacatggtgatcctgacctgcctgatcttcagaaacagcgagggcttccagatcgtgcacgtgcagaagcagcagtgcctgttcaagaacgagaaggtggtggtgggcagctgcaacagaaccatccagaaccagcagtggatgtggaccgaggacgagaagctgctgcacgtgaagagcgccctgtgcctggccatcagcaacagcagcagaggccccagcagaagcgccatcctggacagatgcagccaggcccccagatggacctgctacgaccaggagggcttcctggaggtggagaacgccagcctgttcctgcagaagcagggcagcagagtggtggtgaagaaggccagaaagtacctgcacagctggatgaagatcgacgtgaacaaggagggcaagctggtgaacgagagcctgtgcctgcagaaggccggcctgggcgccgaggtgagcgtgagaagcaccagaaacaccgcccccccccagatcctgaccaccttcaacgccgtgcccgacggcctggtgttcctgatcagaaacaccaccgaggccttcatcagaaacgccgccgagaactacagccagaacagcagcgagagacagcaccccaacctgcacatgaccggcatcaccgacaccagctgggtgctgagcaccacccagcccttcagcagcaccaccgaggagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccgacaaggtggccaacctggaggccaacaacaacggcagaatgagaagcctggtggtgagctggagcccccccgccggcgactgggagcagtacagaatcctgctgttcaacgacagcgtggtgctgctgaacatcaccgtgggcaaggaggagacccagtacgtgatggacgacaccggcctggtgcccggcagacagtacgaggtggaggtgatcgtggagagcggcaacctgaagaacagcgagagatgccagggcagaaccgtgcccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccagcagcgtgagcggcgtgaccgtgaacaacagcggcagaaacgactacctgagcgtgagctggctgctggcccccggcgacgtggacaactacgaggtgaccctgagccacgacggcaaggtggtgcagagcctggtgatcgccaagagcgtgagagagtgcagcttcagcagcctgacccccggcagactgtacaccgtgaccatcaccaccagaagcggcaagtacgagaaccacagcttcagccaggagagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaagagcatccccaagagcgagaacgagtgcgtgttcgtgcagctggtgcccggcagactgtacagcgtgaccgtgaccaccaagagcggccagtacgaggccaacgagcagggcaacggcagaaccatccccgagcccgtgaaggacctgaccctgagaaacagaagcaccgaggacctgcacgtgacctggagcggcgccaacggcgacgtggaccagtacgagatccagctgctgttcaacgacatgaaggtgttcccccccttccacctggtgaacaccgccaccgagtacagattcaccagcctgacccccggcagacagtacaagatcctggtgctgaccatcagcggcgacgtgcagcagagcgccttcatcgagggcttcaccgtgcccagcgccgtgaagaacatccacatcagccccaacggcgccaccgacagcctgaccgtgaactggacccccggcggcggcgacgtggacagctacaccgtgagcgccttcagacacagccagaaggtggacagccagaccatccccaagcacgtgttcgagcacaccttccacagactggaggccggcgagcagtaccagatcatgatcgccagcgtgagcggcagcctgaagaaccagatcaacgtggtgggcagaaccgtgcccgccagcgtgcagggcgtgatcgccgacaacgcctacagcagctacagcctgatcgtgagctggcagaaggccgccggcgtggccgagagatacgacatcctgctgctgaccgagaacggcatcctgctgagaaacaccagcgagcccgccaccaccaagcagcacaagttcgaggacctgacccccggcaagaagtacaagatccagatcctgaccgtgagcggcggcctgttcagcaaggaggcccagaccgagggcagaaccgtgcccgccgccgtgaccgacctgagaatcaccgagaacagcaccagacacctgagcttcagatggaccgccagcgagggcgagctgagctggtacaacatcttcctgtacaaccccgacggcaacctgcaggagagagcccaggtggaccccctggtgcagagcttcagcttccagaacctgctgcagggcagaatgtacaagatggtgatcgtgacccacagcggcgagctgagcaacgagagcttcatcttcggcagaaccgtgcccgccagcgtgagccacctgagaggcagcaacagaaacaccaccgacagcctgtggttcaactggagccccgccagcggcgacttcgacttctacgagctgatcctgtacaaccccaacggcaccaagaaggagaactggaaggacaaggacctgaccgagtggagattccagggcctggtgcccggcagaaagtacgtgctgtgggtggtgacccacagcggcgacctgagcaacaaggtgaccgccgagagcagaaccgcccccagcccccccagcctgatgagcttcgccgacatcgccaacaccagcctggccatcacctggaagggcccccccgactggaccgactacaacgacttcgagctgcagtggctgcccagagacgccctgaccgtgttcaacccctacaacaacagaaagagcgagggcagaatcgtgtacggcctgagacccggcagaagctaccagttcaacgtgaagaccgtgagcggcgacagctggaagacctacagcaagcccatcttcggcagcgtgagaaccaagcccgacaagatccagaacctgcactgcagaccccagaacagcaccgccatcgcctgcagctggatcccccccgacagcgacttcgacggctacagcatcgagtgcagaaagatggacacccaggaggtggagttcagcagaaagctggagaaggagaagagcctgctgaacatcatgatgctggtgccccacaagagatacctggtgagcatcaaggtgcagagcgccggcatgaccagcgaggtggtggaggacagcaccatcaccatgatcgacagacccccccccccccccccccacatcagagtgaacgagaaggacgtgctgatcagcaagagcagcatcaacttcaccgtgaactgcagctggttcagcgacaccaacggcgccgtgaagtacttcaccgtggtggtgagagaggccgacggcagcgacgagctgaagcccgagcagcagcaccccctgcccagctacctggagtacagacacaacgccagcatcagagtgtaccagaccaactacttcgccagcaagtgcgccgagaaccccaacagcaacagcaagagcttcaacatcaagctgggcgccgagatggagagcctgggcggcaagtgcgaccccacccagcagaagttctgcgacggccccctgaagccccacaccgcctacagaatcagcatcagagccttcacccagctgttcgacgaggacctgaaggagttcaccaagcccctgtacagcgacaccttcttcagcctgcccatcaccaccgagagcgagcccctgttcggcgccatcgagggcgtgagcgccggcctgttcctgatcggcatgctggtggccgtggtggccctgctgatctgcagacagaaggtgagccacggcagagagagacccagcgccagactgagcatcagaagagacagacccctgagcgtgcacctgaacctgggccagaagggcaacagaaagaccagctgccccatcaagatcaaccagttcgagggccacttcatgaagctgcaggccgacagcaactacctgctgagcaaggagtacgaggagctgaaggacgtgggcagaaaccagagctgcgacatcgccctgctgcccgagaacagaggcaagaacagatacaacaacatcctgccctacgacgccaccagagtgaagctgagcaacgtggacgacgacccctgcagcgactacatcaacgccagctacatccccggcaacaacttcagaagagagtacatcgtgacccagggccccctgcccggcaccaaggacgacttctggaagatggtgtgggagcagaacgtgcacaacatcgtgatggtgacccagtgcgtggagaagggcagagtgaagtgcgaccactactggcccgccgaccaggacagcctgtactacggcgacctgatcctgcagatgctgagcgagagcgtgctgcccgagtggaccatcagagagttcaagatctgcggcgaggagcagctggacgcccacagactgatcagacacttccactacaccgtgtggcccgaccacggcgtgcccgagaccacccagagcctgatccagttcgtgagaaccgtgagagactacatcaacagaagccccggcgccggccccaccgtggtgcactgcagcgccggcgtgggcagaaccggcaccttcatcgccctggacagaatcctgcagcagctggacagcaaggacagcgtggacatctacggcgccgtgcacgacctgagactgcacagagtgcacatggtgcagaccgagtgccagtacgtgtacctgcaccagtgcgtgagagacgtgctgagagccagaaagctgagaagcgagcaggagaaccccctgttccccatctacgagaacgtgaaccccgagtaccacagagaccccgtgtacagcagacactag

SEQ ID NO: 95512 - DNA, 5724 bp, Artificial Sequence
  Description of Artificial Sequence: Synthetic coding sequence
atgctgagccacggcgccggcctggccctgtggatcaccctgagcctgctgcagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccagcagcgtgagcggcgtgaccgtgaacaacagcggcagaaacgactacctgagcgtgagctggctgctggcccccggcgacgtggacaactacgaggtgaccctgagccacgacggcaaggtggtgcagagcctggtgatcgccaagagcgtgagagagtgcagcttcagcagcctgacccccggcagactgtacaccgtgaccatcaccaccagaagcggcaagtacgagaaccacagcttcagccaggagagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaagagcatccccaagagcgagaacgagtgcgtgttcgtgcagctggtgcccggcagactgtacagcgtgaccgtgaccaccaagagcggccagtacgaggccaacgagcagggcaacggcagaaccatccccgagcccgtgaaggacctgaccctgagaaacagaagcaccgaggacctgcacgtgacctggagcggcgccaacggcgacgtggaccagtacgagatccagctgctgttcaacgacatgaaggtgttcccccccttccacctggtgaacaccgccaccgagtacagattcaccagcctgacccccggcagacagtacaagatcctggtgctgaccatcagcggcgacgtgcagcagagcgccttcatcgagggcttcaccgtgcccagcgccgtgaagaacatccacatcagccccaacggcgccaccgacagcctgaccgtgaactggacccccggcggcggcgacgtggacagctacaccgtgagcgccttcagacacagccagaaggtggacagccagaccatccccaagcacgtgttcgagcacaccttccacagactggaggccggcgagcagtaccagatcatgatcgccagcgtgagcggcagcctgaagaaccagatcaacgtggtgggcagaaccgtgcccgccagcgtgcagggcgtgatcgccgacaacgcctacagcagctacagcctgatcgtgagctggcagaaggccgccggcgtggccgagagatacgacatcctgctgctgaccgagaacggcatcctgctgagaaacaccagcgagcccgccaccaccaagcagcacaagttcgaggacctgacccccggcaagaagtacaagatccagatcctgaccgtgagcggcggcctgttcagcaaggaggcccagaccgagggcagaaccgtgcccgccgccgtgaccgacctgagaatcaccgagaacagcaccagacacctgagcttcagatggaccgccagcgagggcgagctgagctggtacaacatcttcctgtacaaccccgacggcaacctgcaggagagagcccaggtggaccccctggtgcagagcttcagcttccagaacctgctgcagggcagaatgtacaagatggtgatcgtgacccacagcggcgagctgagcaacgagagcttcatcttcggcagaaccgtgcccgccagcgtgagccacctgagaggcagcaacagaaacaccaccgacagcctgtggttcaactggagccccgccagcggcgacttcgacttctacgagctgatcctgtacaaccccaacggcaccaagaaggagaactggaaggacaaggacctgaccgagtggagattccagggcctggtgcccggcagaaagtacgtgctgtgggtggtgacccacagcggcgacctgagcaacaaggtgaccgccgagagcagaaccgcccccagcccccccagcctgatgagcttcgccgacatcgccaacaccagcctggccatcacctggaagggcccccccgactggaccgactacaacgacttcgagctgcagtggctgcccagagacgccctgaccgtgttcaacccctacaacaacagaaagagcgagggcagaatcgtgtacggcctgagacccggcagaagctaccagttcaacgtgaagaccgtgagcggcgacagctggaagacctacagcaagcccatcttcggcagcgtgagaaccaagcccgacaagatccagaacctgcactgcagaccccagaacagcaccgccatcgcctgcagctggatcccccccgacagcgacttcgacggctacagcatcgagtgcagaaagatggacacccaggaggtggagttcagcagaaagctggagaaggagaagagcctgctgaacatcatgatgctggtgccccacaagagatacctggtgagcatcaaggtgcagagcgccggcatgaccagcgaggtggtggaggacagcaccatcaccatgatcgacagacccccccccccccccccccacatcagagtgaacgagaaggacgtgctgatcagcaagagcagcatcaacttcaccgtgaactgcagctggttcagcgacaccaacggcgccgtgaagtacttcaccgtggtggtgagagaggccgacggcaacgacgagctgaagcccgagcagcagcaccccctgcccagctacctggagtacagacacaacgccagcatcagagtgtaccagaccaactacttcgccagcaagtgcgccgagaaccccaacagcaacagcaagagcttcaacatcaagctgggcgccgagatggagagcctgggcggcaagtgcgaccccacccagcagaagttctgcgacggccccctgaagccccacaccgcctacagaatcagcatcagagccttcacccagctgttcgacgaggacctgaaggagttcaccaagcccctgtacagcgacaccttcttcagcctgcccatcaccaccgagagcgagcccctgttcggcgccatcgagggcgtgagcgccggcctgttcctgatcggcatgctggtggccgtggtggccctgctgatctgcagacagaaggtgagccacggcagagagagacccagcgccagactgagcatcagaagagacagacccctgagcgtgcacctgaacctgggccagaagggcaacagaaagaccagctgccccatcaagatcaaccagttcgagggccacttcatgaagctgcaggccgacagcaactacctgctgagcaaggagtacgaggagctgaaggacgtgggcagaaaccagagctgcgacatcgccctgctgcccgagaacagaggcaagaacagatacaacaacatcctgccctacgacgccaccagagtgaagctgagcaacgtggacgacgacccctgcagcgactacatcaacgccagctacatccccggcaacaacttcagaagagagtacatcgtgacccagggccccctgcccggcaccaaggacgacttctggaagatggtgtgggagcagaacgtgcacaacatcgtgatggtgacccagtgcgtggagaagggcagagtgaagtgcgaccactactggcccgccgaccaggacagcctgtactacggcgacctgatcctgcagatgctgagcgagagcgtgctgcccgagtggaccatcagagagttcaagatctgcggcgaggagcagctggacgcccacagactgatcagacacttccactacaccgtgtggcccgaccacggcgtgcccgagaccacccagagcctgatccagttcgtgagaaccgtgagagactacatcaacagaagccccggcgccggccccaccgtggtgcactgcagcgccggcgtgggcagaaccggcaccttcatcgccctggacagaatcctgcagcagctggacagcaaggacagcgtggacatctacggcgccgtgcacgacctgagactgcacagagtgcacatggtgcagaccgagtgccagtacgtgtacctgcaccagtgcgtgagagacgtgctgagagccagaaagctgagaagcgagcaggagaaccccctgttccccatctacgagaacgtgaaccccgagtaccacagagaccccgtgtacagcagacactag

SEQ ID NO: 95513 - DNA, 2760 bp, Artificial Sequence
  Description of Artificial Sequence: Synthetic coding sequence
atggaggccgagttctacatggtgatcctgacctgcctgatcttcagaaacagcgagggcttccagatcgtgcacgtgcagaagcagcagtgcctgttcaagaacgagaaggtggtggtgggcagctgcaacagaaccatccagaaccagcagtggatgtggaccgaggacgagaagctgctgcacgtgaagagcgccctgtgcctggccatcagcaacagcagcagaggccccagcagaagcgccatcctggacagatgcagccaggcccccagatggacctgctacgaccaggagggcttcctggaggtggagaacgccagcctgttcctgcagaagcagggcagcagagtggtggtgaagaaggccagaaagtacctgcacagctggatgaagatcgacgtgaacaaggagggcaagctggtgaacgagagcctgtgcctgcagaaggccggcctgggcgccgaggtgagcgtgagaagcaccagaaacaccgcccccccccagatcctgaccaccttcaacgccgtgcccgacggcctggtgttcctgatcagaaacaccaccgaggccttcatcagaaacgccgccgagaactacagccagaacagcagcgagagacagcaccccaacctgcacatgaccggcatcaccgacaccagctgggtgctgagcaccacccagcccttcagcagcaccaccgaggagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccgacaaggtggccaacctggaggccaacaacaacggcagaatgagaagcctggtggtgagctggagcccccccgccggcgactgggagcagtacagaatcctgctgttcaacgacagcgtggtgctgctgaacatcaccgtgggcaaggaggagacccagtacgtgatggacgacaccggcctggtgcccggcagacagtacgaggtggaggtgatcgtggagagcggcaacctgaagaacagcgagagatgccagggcagaaccgtgcccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaaggccttccccagccagaagaccaacgtgtacctgttcagctag

SEQ ID NO: 95514 - DNA, 5724 bp, Artificial Sequence
  Description of Artificial Sequence: Synthetic coding sequence
atgctgagccacggcgccggcctggccctgtggatcaccctgagcctgctgcagaccggcctggccgagcccgagagatgcaacttcaccctggccgagagcaaggccagcagccacagcgtgagcatccagtggagaatcctgggcagcccctgcaacttcagcctgatctacagcagcgacaccctgggcgccgccctgtgccccaccttcagaatcgacaacaccacctacggctgcaacctgcaggacctgcaggccggcaccatctacaacttcagaatcatcagcctggacgaggagagaaccgtggtgctgcagaccgaccccctgccccccgccagattcggcgtgagcaaggagaagaccaccagcaccagcctgcacgtgtggtggacccccagcagcggcaaggtgaccagctacgaggtgcagctgttcgacgagaacaaccagaagatccagggcgtgcagatccaggagagcaccagctggaacgagtacaccttcttcaacctgaccgccggcagcaagtacaacatcgccatcaccgccgtgagcggcggcaagagaagcttcagcgtgtacaccaacggcagcaccgtgcccagccccgtgaaggacatcggcatcagcaccaaggccaacagcctgctgatcagctggagccacggcagcggcaacgtggagagatacagactgatgctgatggacaagggcatcctggtgcacggcggcgtggtggacaagcacgccaccagctacgccttccacggcctgacccccggctacctgtacaacctgaccgtgatgaccgaggccgccggcctgcagaactacagatggaagctggtgagaaccgcccccatggaggtgagcaacctgaaggtgaccaacgacggcagcctgaccagcctgaaggtgaagtggcagagaccccccggcaacgtggacagctacaacatcaccctgagccacaagggcaccatcaaggagagcagagtgctggccccctggatcaccgagacccacttcaaggagctggtgcccggcagactgtaccaggtgaccgtgagctgcgtgagcggcgagctgagcgcccagaagatggccgtgggcagaaccttccccctggccgtgctgcagctgagagtgaagcacgccaacgagaccagcctgagcatcatgtggcagacccccgtggccgagtgggagaagtacatcatcagcctggccgacagagacctgctgctgatccacaagagcctgagcaaggacgccaaggagttcaccttcaccgacctggtgcccggcagaaagtacatggccaccgtgaccagcatcagcggcgacctgaagaacagcagcagcgtgaagggcagaaccgtgcccgcccaggtgaccgacctgcacgtggccaaccagggcatgaccagcagcctgttcaccaactggacccaggcccagggcgacgtggagttctaccaggtgctgctgatccacgagaacgtggtgatcaagaacgagagcatcagcagcgagaccagcagatacagcttccacagcctgaagagcggcagcctgtacagcgtggtggtgaccaccgtgagcggcggcatcagcagcagacaggtggtggtggagggcagaaccgtgcccagcagcgtgagcggcgtgaccgtgaacaacagcggcagaaacgactacctgagcgtgagctggctgctggcccccggcgacgtggacaactacgaggtgaccctgagccacgacggcaaggtggtgcagagcctggtgatcgccaagagcgtgagagagtgcagcttcagcagcctgacccccggcagactgtacaccgtgaccatcaccaccagaagcggcaagtacgagaaccacagcttcagccaggagagaaccgtgcccgacaaggtgcagggcgtgagcgtgagcaacagcgccagaagcgactacctgagagtgagctgggtgcacgccaccggcgacttcgaccactacgaggtgaccatcaagaacaagaacaacttcatccagaccaagagcatccccaagagcgagaacgagtgcgtgttcgtgcagctggtgcccggcagactgtacagcgtgaccgtgaccaccaagagcggccagtacgaggccaacgagcagggcaacggcagaaccatccccgagcccgtgaaggacctgaccctgagaaacagaagcaccgaggacctgcacgtgacctggagcggcgccaacggcgacgtggaccagtacgagatccagctgctgttcaacgacatgaaggtgttcccccccttccacctggtgaacaccgccaccgagtacagattcaccagcctgacccccggcagacagtacaagatcctggtgctgaccatcagcggcgacgtgcagcagagcgccttcatcgagggcttcaccgtgcccagcgccgtgaagaacatccacatcagccccaacggcgccaccgacagcctgaccgtgaactggacccccggcggcggcgacgtggacagctacaccgtgagcgccttcagacacagccagaaggtggacagccagaccatccccaagcacgtgttcgagcacaccttccacagactggaggccggcgagcagtaccagatcatgatcgccagcgtgagcggcagcctgaagaaccagatcaacgtggtgggcagaaccgtgcccgccagcgtgcagggcgtgatcgccgacaacgcctacagcagctacagcctgatcgtgagctggcagaaggccgccggcgtggccgagagatacgacatcctgctgctgaccgagaacggcatcctgctgagaaacaccagcgagcccgccaccaccaagcagcacaagttcgaggacctgacccccggcaagaagtacaagatccagatcctgaccgtgagcggcggcctgttcagcaaggaggcccagaccgagggcagaaccgtgcccgccgccgtgaccgacctgagaatcaccgagaacagcaccagacacctgagcttcagatggaccgccagcgagggcgagctgagctggtacaacatcttcctgtacaaccccgacggcaacctgcaggagagagcccaggtggaccccctggtgcagagcttcagcttccagaacctgctgcagggcagaatgtacaagatggtgatcgtgacccacagcggcgagctgagcaacgagagcttcatcttcggcagaaccgtgcccgccagcgtgagccacctgagaggcagcaacagaaacaccaccgacagcctgtggttcaactggagccccgccagcggcgacttcgacttctacgagctgatcctgtacaaccccaacggcaccaagaaggagaactggaaggacaaggacctgaccgagtggagattccagggcctggtgcccggcagaaagtacgtgctgtgggtggtgacccacagcggcgacctgagcaacaaggtgaccgccgagagcagaaccgcccccagcccccccagcctgatgagcttcgccgacatcgccaacaccagcctggccatcacctggaagggcccccccgactggaccgactacaacgacttcgagctgcagtggctgcccagagacgccctgaccgtgttcaacccctacaacaacagaaagagcgagggcagaatcgtgtacggcctgagacccggcagaagctaccagttcaacgtgaagaccgtgagcggcgacagctggaagacctacagcaagcccatcttcggcagcgtgagaaccaagcccgacaagatccagaacctgcactgcagaccccagaacagcaccgccatcgcctgcagctggatcccccccgacagcgacttcgacggctacagcatcgagtgcagaaagatggacacccaggaggtggagttcagcagaaagctggagaaggagaagagcctgctgaacatcatgatgctggtgccccacaagagatacctggtgagcatcaaggtgcagagcgccggcatgaccagcgaggtggtggaggacagcaccatcaccatgatcgacagacccccccccccccccccccacatcagagtgaacgagaaggacgtgctgatcagcaagagcagcatcaacttcaccgtgaactgcagctggttcagcgacaccaacggcgccgtgaagtacttcaccgtggtggtgagagaggccgacggcagcgacgagctgaagcccgagcagcagcaccccctgcccagctacctggagtacagacacaacgccagcatcagagtgtaccagaccaactacttcgccagcaagtgcgccgagaaccccaacagcaacagcaagagcttcaacatcaagctgggcgccgagatggagagcctgggcggcaagtgcgaccccacccagcagaagttctgcgacggccccctgaagccccacaccgcctacagaatcagcatcagagccttcacccagctgttcgacgaggacctgaaggagttcaccaagcccctgtacagcgacaccttcttcagcctgcccatcaccaccgagagcgagcccctgttcggcgccatcgagggcgtgagcgccggcctgttcctgatcggcatgctggtggccgtggtggccctgctgatctgcagacagaaggtgagccacggcagagagagacccagcgccagactgagcatcagaagagacagacccctgagcgtgcacctgaacctgggccagaagggcaacagaaagaccagctgccccatcaagatcaaccagttcgagggccacttcatgaagctgcaggccgacagcaactacctgctgagcaaggagtacgaggagctgaaggacgtgggcagaaaccagagctgcgacatcgccctgctgcccgagaacagaggcaagaacagatacaacaacatcctgccctacgacgccaccagagtgaagctgagcaacgtggacgacgacccctgcagcgactacatcaacgccagctacatccccggcaacaacttcagaagagagtacatcgtgacccagggccccctgcccggcaccaaggacgacttctggaagatggtgtgggagcagaacgtgcacaacatcgtgatggtgacccagtgcgtggagaagggcagagtgaagtgcgaccactactggcccgccgaccaggacagcctgtactacggcgacctgatcctgcagatgctgagcgagagcgtgctgcccgagtggaccatcagagagttcaagatctgcggcgaggagcagctggacgcccacagactgatcagacacttccactacaccgtgtggcccgaccacggcgtgcccgagaccacccagagcctgatccagttcgtgagaaccgtgagagactacatcaacagaagccccggcgccggccccaccgtggtgcactgcagcgccggcgtgggcagaaccggcaccttcatcgccctggacagaatcctgcagcagctggacagcaaggacagcgtggacatctacggcgccgtgcacgacctgagactgcacagagtgcacatggtgcagaccgagtgccagtacgtgtacctgcaccagtgcgtgagagacgtgctgagagccagaaagctgagaagcgagcaggagaaccccctgttccccatctacgagaacgtgaaccccgagtaccacagagaccccgtgtacagcagacactag

SEQ ID NO: 95515 - DNA, 621 bp, Artificial Sequence
  Description of Artificial Sequence: Synthetic coding sequence
atggccctgccctgcaccctgggcctgggcatgctgctggccctgcccggcgccctgggcagcggcggcagcgccgaggacagcgtgggcagcagcagcgtgaccgtggtgctgctgctgctgctgctgctgctgctggccaccggcctggccctggcctggagaagactgagcagagacagcggcggctactaccaccccgccagactgggcgccgccctgtggggcagaaccagaagactgctgtgggccagcccccccggcagatggctgcaggccagagccgagctgggcagcaccgacaacgacctggagagacaggaggacgagcaggacaccgactacgaccacgtggccgacggcggcctgcaggccgaccccggcgagggcgagcagcagtgcggcgaggccagcagccccgagcaggtgcccgtgagagccgaggaggccagagacagcgacaccgagggcgacctggtgctgggcagccccggccccgccagcgccggcggcagcgccgaggccctgctgagcgacctgcacgccttcgccggcagcgccgcctgggacgacagcgccagagccgccggcggccagggcctgcacgtgaccgccctgtag

SEQ ID NO: 95516 - DNA, 4152 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgtgagcgtgtgcgccacctaccacaccggcgccctgcagatcgagcagagcgaggagagcgaccagggcaagtacgagtgcgtggccaccaacagcgccggcaccagatacagcgcccccgccaacctgtacgtgagagtgaacagaaaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcagcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95517 - DNA, 4521 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgagagcatcggcggcacccccatcagaggcgccctgcagatcgagcagagcgaggagagcgaccagggcaagtacgagtgcgtggccaccaacagcgccggcaccagatacagcgcccccgccaacctgtacgtgagagagctgagagaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagcagcaagcccgacagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95518 - DNA, 5739 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgagagcatcggcggcacccccatcagaggcgccctgcagatcgagcagagcgaggagagcgaccagggcaagtacgagtgcgtggccaccaacagcgccggcaccagatacagcgcccccgccaacctgtacgtgagagagctgagagaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcaagcccagcgcccccccccaggacatcagctgcaccagccccagcagcaccagcatcctggtgagctggcagcccccccccgtggagaagcagaacggcatcatcaccgagtacagcatcaagtacaccgccgtggacggcgaggacgacaagccccacgagatcctgggcatccccagcgacaccaccaagtacctgctggagcagctggagaagtggaccgagtacagaatcaccgtgaccgcccacaccgacgtgggccccggccccgagagcctgagcgtgctgatcagaaccaacgaggacgtgcccagcggcccccccagaaaggtggaggtggaggccgtgaacagcaccagcgtgaaggtgagctggagaagccccgtgcccaacaagcagcacggccagatcagaggctaccaggtgcactacgtgagaatggagaacggcgagcccaagggccagcccatgctgaaggacgtgatgctggccgacgcccagtgggagttcgacgacaccaccgagcacgacatgatcatcagcggcctgcagcccgagaccagctacagcctgaccgtgaccgcctacaccaccaagggcgacggcgccagaagcaagcccaagctggtgagcaccaccggcgccgtgcccggcaagcccagactggtgatcaaccacacccagatgaacaccgccctgatccagtggcacccccccgtggacaccttcggccccctgcagggctacagactgaagttcggcagaaaggacatggagcccctgaccaccctggagttcagcgagaaggaggaccacttcaccgccaccgacatccacaagggcgccagctacgtgttcagactgagcgccagaaacaaggtgggcttcggcgaggagatggtgaaggagatcagcatccccgaggaggtgcccaccggcttcccccagaacctgcacagcgagggcaccaccagcaccagcgtgcagctgagctggcagccccccgtgctggccgagagaaacggcatcatcaccaagtacaccctgctgtacagagacatcaacatccccctgctgcccatggagcagctgatcgtgcccgccgacaccaccatgaccctgaccggcctgaagcccgacaccacctacgacgtgaaggtgagagcccacaccagcaagggccccggcccctacagccccagcgtgcagttcagaaccctgcccgtggaccaggtgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95519 - DNA, 5673 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcggcgccctgcagatcgagcagagcgaggagagcgaccagggcaagtacgagtgcgtggccaccaacagcgccggcaccagatacagcgcccccgccaacctgtacgtgagagtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcaagcccagcgcccccccccaggacatcagctgcaccagccccagcagcaccagcatcctggtgagctggcagcccccccccgtggagaagcagaacggcatcatcaccgagtacagcatcaagtacaccgccgtggacggcgaggacgacaagccccacgagatcctgggcatccccagcgacaccaccaagtacctgctggagcagctggagaagtggaccgagtacagaatcaccgtgaccgcccacaccgacgtgggccccggccccgagagcctgagcgtgctgatcagaaccaacgaggacgtgcccagcggcccccccagaaaggtggaggtggaggccgtgaacagcaccagcgtgaaggtgagctggagaagccccgtgcccaacaagcagcacggccagatcagaggctaccaggtgcactacgtgagaatggagaacggcgagcccaagggccagcccatgctgaaggacgtgatgctggccgacgcccaggacatgatcatcagcggcctgcagcccgagaccagctacagcctgaccgtgaccgcctacaccaccaagggcgacggcgccagaagcaagcccaagctggtgagcaccaccggcgccgtgcccggcaagcccagactggtgatcaaccacacccagatgaacaccgccctgatccagtggcacccccccgtggacaccttcggccccctgcagggctacagactgaagttcggcagaaaggacatggagcccctgaccaccctggagttcagcgagaaggaggaccacttcaccgccaccgacatccacaagggcgccagctacgtgttcagactgagcgccagaaacaaggtgggcttcggcgaggagatggtgaaggagatcagcatccccgaggaggtgcccaccggcttcccccagaacctgcacagcgagggcaccaccagcaccagcgtgcagctgagctggcagccccccgtgctggccgagagaaacggcatcatcaccaagtacaccctgctgtacagagacatcaacatccccctgctgcccatggagcagctgatcgtgcccgccgacaccaccatgaccctgaccggcctgaagcccgacaccacctacgacgtgaaggtgagagcccacaccagcaagggccccggcccctacagccccagcgtgcagttcagaaccctgcccgtggaccaggtgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95520 - DNA, 5700 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcggcgccctgcagatcgagcagagcgaggagagcgaccagggcaagtacgagtgcgtggccaccaacagcgccggcaccagatacagcgcccccgccaacctgtacgtgagagtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcaagcccagcgcccccccccaggacatcagctgcaccagccccagcagcaccagcatcctggtgagctggcagcccccccccgtggagaagcagaacggcatcatcaccgagtacagcatcaagtacaccgccgtggacggcgaggacgacaagccccacgagatcctgggcatccccagcgacaccaccaagtacctgctggagcagctggagaagtggaccgagtacagaatcaccgtgaccgcccacaccgacgtgggccccggccccgagagcctgagcgtgctgatcagaaccaacgaggacgtgcccagcggcccccccagaaaggtggaggtggaggccgtgaacagcaccagcgtgaaggtgagctggagaagccccgtgcccaacaagcagcacggccagatcagaggctaccaggtgcactacgtgagaatggagaacggcgagcccaagggccagcccatgctgaaggacgtgatgctggccgacgcccagtgggagttcgacgacaccaccgagcacgacatgatcatcagcggcctgcagcccgagaccagctacagcctgaccgtgaccgcctacaccaccaagggcgacggcgccagaagcaagcccaagctggtgagcaccaccggcgccgtgcccggcaagcccagactggtgatcaaccacacccagatgaacaccgccctgatccagtggcacccccccgtggacaccttcggccccctgcagggctacagactgaagttcggcagaaaggacatggagcccctgaccaccctggagttcagcgagaaggaggaccacttcaccgccaccgacatccacaagggcgccagctacgtgttcagactgagcgccagaaacaaggtgggcttcggcgaggagatggtgaaggagatcagcatccccgaggaggtgcccaccggcttcccccagaacctgcacagcgagggcaccaccagcaccagcgtgcagctgagctggcagccccccgtgctggccgagagaaacggcatcatcaccaagtacaccctgctgtacagagacatcaacatccccctgctgcccatggagcagctgatcgtgcccgccgacaccaccatgaccctgaccggcctgaagcccgacaccacctacgacgtgaaggtgagagcccacaccagcaagggccccggcccctacagccccagcgtgcagttcagaaccctgcccgtggaccaggtgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95521 - DNA, 5739 bp, Artificial Sequence; identical to SEQ ID NO: 95518
  Description of Artificial Sequence: Synthetic coding sequence

SEQ ID NO: 95522 - DNA, 4509 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcggcggcacccccatcagaggcgccctgcagatcgagcagagcgaggagagcgaccagggcaagtacgagtgcgtggccaccaacagcgccggcaccagatacagcgcccccgccaacctgtacgtgagagagctgagagaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagcaagcccgacagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95523 - DNA, 4518 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgtgagcatcggcgccctgcagatcgagcagagcgaggagagcgaccagggcaagtacgagtgcgtggccaccaacagcgccggcaccagatacagcgcccccgccaacctgtacgtgagagtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagagagccgagagcgacagcagaaagagcagcatccccaacaacaaggagatccccagccaccaccccaccgaccccgtggagctgagaagactgaacttccagacccccggcagcgacgacagcggctaccccggcaacctgcacagcagcagcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95524 - DNA, 282 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgagtag

SEQ ID NO: 95525 - DNA, 4518 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcgagagcatcggcggcacccccatcagaggcgccctgcagatcgagcagagcgaggagagcgaccagggcaagtacgagtgcgtggccaccaacagcgccggcaccagatacagcgcccccgccaacctgtacgtgagagagctgagagaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagcaagcccgacagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95526 - DNA, 4509 bp, Artificial Sequence
  Description of Artificial Sequence: Synthetic coding sequence
atggtgcacgtggccagactgctgctgctgctgctgaccttcttcctgagaaccgacgccgagaccccccccagattcaccagaacccccgtggaccagaccggcgtgagcggcggcgtggccagcttcatctgccaggccaccggcgaccccagacccaagatcgtgtggaacaagaagggcaagaaggtgagcaaccagagattcgaggtgatcgagttcgacgacggcagcggcagcgtgctgagaatccagcccctgagaacccccagagacgaggccatctacgagtgcgtggccagcaacaacgtgggcgagatcagcgtgagcaccagactgaccgtgctgagagaggaccagatccccagaggcttccccaccatcgacatgggcccccagctgaaggtggtggagagaaccagaaccgccaccatgctgtgcgccgccagcggcaaccccgaccccgagatcacctggttcaaggacttcctgcccgtggacaccagcaacaacaacggcagaatcaagcagctgagaagcggcagagtgttccacaccggcgccctgcagatcgagcagagcgaggagagcgaccagggcaagtacgagtgcgtggccaccaacagcgccggcaccagatacagcgcccccgccaacctgtacgtgagagtgaacagaaaggtgagaagagtgccccccagattcagcatcccccccaccaaccacgagatcatgcccggcggcagcgtgaacatcacctgcgtggccgtgggcagccccatgccctacgtgaagtggatgctgggcgccgaggacctgacccccgaggacgacatgcccatcggcagaaacgtgctggagctgaacgacgtgagacagagcgccaactacacctgcgtggccatgagcaccctgggcgtgatcgaggccatcgcccagatcaccgtgaaggccctgcccaagccccccggcacccccgtggtgaccgagagcaccgccaccagcatcaccctgacctgggacagcggcaaccccgagcccgtgagctactacatcatccagcacaagcccaagaacagcgaggagctgtacaaggagatcgacggcgtggccaccaccagatacagcgtggccggcctgagcccctacagcgactacgagttcagagtggtggccgtgaacaacatcggcagaggcccccccagcgagcccgtgctgacccagaccagcgagcaggcccccagcagcgcccccagagacgtgcaggccagaatgctgagcagcaccaccatcctggtgcagtggaaggagcccgaggagcccaacggccagatccagggctacagagtgtactacaccatggaccccacccagcacgtgaacaactggatgaagcacaacgtggccgacagccagatcaccaccatcggcaacctggtgccccagaagacctacagcgtgaaggtgctggccttcaccagcatcggcgacggccccctgagcagcgacatccaggtgatcacccagaccggcgtgcccggccagcccctgaacttcaaggccgagcccgagagcgagaccagcatcctgctgagctggaccccccccagaagcgacaccatcgccaactacgagctggtgtacaaggacggcgagcacggcgaggagcagagaatcaccatcgagcccggcaccagctacagactgcagggcctgaagcccaacagcctgtactacttcagactggccgccagaagcccccagggcctgggcgccagcaccgccgagatcagcgccagaaccatgcagagcatgttcgccaagaacttccacgtgaaggccgtgatgaagaccagcgtgctgctgagctgggagatccccgagaactacaacagcgccatgcccttcaagatcctgtacgacgacggcaagatggtggaggaggtggacggcagagccacccagaagctgatcgtgaacctgaagcccgagaagagctacagcttcgtgctgaccaacagaggcaacagcgccggcggcctgcagcacagagtgaccgccaagaccgcccccgacgtgctgagaaccaagcccgccttcatcggcaagaccaacctggacggcatgatcaccgtgcagctgcccgaggtgcccgccaacgagaacatcaagggctactacatcatcatcgtgcccctgaagaagagcagaggcaagttcatcaagccctgggagagccccgacgagatggagctggacgagctgctgaaggagatcagcagaaagagaagaagcatcagatacggcagagaggtggagctgaagccctacatcgccgcccacttcgacgtgctgcccaccgagttcaccctgggcgacgacaagcactacggcggcttcaccaacaagcagctgcagagcggccaggagtacgtgttcttcgtgctggccgtgatggagcacgccgagagcaagatgtacgccaccagcccctacagcgaccccgtggtgagcatggacctggacccccagcccatcaccgacgaggaggagggcctgatctgggtggtgggccccgtgctggccgtggtgttcatcatctgcatcgtgatcgccatcctgctgtacaagagaaagccctacagaaagagagccgagagcgacagcagaaagagcagcatccccaacaacaaggagatccccagccaccaccccaccgaccccgtggagctgagaagactgaacttccagacccccggcatggccagccacccccccatccccatcctggagctggccgaccacatcgagagactgaaggccaacgacaacctgaagttcagccaggagtacgagagcatcgaccccggccagcagttcacctgggagcacagcaacctggaggtgaacaagcccaagaacagatacgccaacgtgatcgcctacgaccacagcagagtgctgctgagcgccatcgagggcatccccggcagcgactacgtgaacgccaactacatcgacggctacagaaagcagaacgcctacatcgccacccagggcagcctgcccgagaccttcggcgacttctggagaatgatctgggagcagagaagcgccaccgtggtgatgatgaccaagctggaggagagaagcagagtgaagtgcgaccagtactggcccagcagaggcaccgagacccacggcctggtgcaggtgaccctgctggacaccgtggagctggccacctactgcgtgagaaccttcgccctgtacaagaacggcagcagcgagaagagagaggtgagacagttccagttcaccgcctggcccgaccacggcgtgcccgagcaccccacccccttcctggccttcctgagaagagtgaagacctgcaacccccccgacgccggccccatggtggtgcactgcagcgccggcgtgggcagaaccggctgcttcatcgtgatcgacgccatgctggagagaatcaagcacgagaagaccgtggacatctacggccacgtgaccctgatgagagcccagagaaactacatggtgcagaccgaggaccagtacatcttcatccacgacgccctgctggaggccgtgacctgcggcaacaccgaggtgcccgccagaaacctgtacgcctacatccagaagctgacccagatcgagaccggcgagaacgtgaccggcatggagctggagttcaagagactggccagcagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagcacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggaccagtaccagttcagctacagagccgccctggagtacctgggcagcttcgaccactacgccacctag

SEQ ID NO: 95527 - DNA, 5739 bp, Artificial Sequence; identical to SEQ ID NO: 95518
  Description of Artificial Sequence: Synthetic coding sequence

SEQ ID NO: 95528 - DNA, 2103 bp, Artificial Sequence
  Description of Artificial Sequence: Synthetic coding sequence
atggagcccctgtgccccctgctgctggtgggcttcagcctgcccctggccagagccctgagaggcaacgagaccaccgccgacagcaacgagaccaccaccaccagcggcccccccgaccccggcgccagccagcccctgctggcctggctgctgctgcccctgctgctgctgctgctggtgctgctgctggccgcctacttcttcagattcagaaagcagagaaaggccgtggtgagcaccagcgacaagaagatgcccaacggcatcctggaggagcaggagcagcagagagtgatgctgctgagcagaagccccagcggccccaagaagtacttccccatccccgtggagcacctggaggaggagatcagaatcagaagcgccgacgactgcaagcagttcagagaggagttcaacagcctgcccagcggccacatccagggcaccttcgagctggccaacaaggaggagaacagagagaagaacagataccccaacatcctgcccaacgaccacagcagagtgatcctgagccagctggacggcatcccctgcagcgactacatcaacgccagctacatcgacggctacaaggagaagaacaagttcatcgccgcccagggccccaagcaggagaccgtgaacgacttctggagaatggtgtgggagcagaagagcgccaccatcgtgatgctgaccaacctgaaggagagaaaggaggagaagtgccaccagtactggcccgaccagggctgctggacctacggcaacatcagagtgtgcgtggaggactgcgtggtgctggtggactacaccatcagaaagttctgcatccagccccagctgcccgacggctgcaaggcccccagactggtgagccagctgcacttcaccagctggcccgacttcggcgtgcccttcacccccatcggcatgctgaagttcctgaagaaggtgaagaccctgaaccccgtgcacgccggccccatcgtggtgcactgcagcgccggcgtgggcagaaccggcaccttcatcgtgatcgacgccatgatggccatgatgcacgccgagcagaaggtggacgtgttcgagttcgtgagcagaatcagaaaccagagaccccagatggtgcagaccgacatgcagtacaccttcatctaccaggccctgctggagtactacctgtacggcgacaccgagctggacgtgagcagcctggagaagcacctgcagaccatgcacggcaccaccacccacttcgacaagatcggcctggaggaggagttcagaaagctgaccaacgtgagaatcatgaaggagaacatgagaaccggcaacctgcccgccaacatgaagaaggccagagtgatccagatcatcccctacgacttcaacagagtgatcctgagcatgaagagaggccaggagtacaccgactacatcaacgccagcttcatcgacggctacagacagaaggactacttcatcgccacccagggccccctggcccacaccgtggaggacttctggagaatgatctgggagtggaagagccacaccatcgtgatgctgaccgaggtgcaggagagagagcaggacaagtgctaccagtactggcccaccgagggcagcgtgacccacggcgagatcaccatcgagatcaagaacgacaccctgagcgaggccatcagcatcagagacttcctggtgaccctgaaccagccccaggccagacaggaggagcaggtgagagtggtgagacagttccacttccacggctggcccgagatcggcatccccgccgagggcaagggcatgatcgacctgatcgccgccgtgcagaagcagcagcagcagaccggcaaccaccccatcaccgtgcactgcagcgccggcgccggcagaaccggcaccttcatcgccctgagcaacatcctggagagagtgaaggccgagggcctgctggacgtgttccaggccgtgaagagcctgagactgcagagaccccacatggtgcagaccctggagcagtacgagttctgctacaaggtggtgcaggacttcatcgacatcttcagcgactacgccaacttcaagtag

SEQ ID NO: 95529 - DNA, 1929 bp, Artificial Sequence
  Description of Artificial Sequence: Synthetic coding sequence
atgagcaacagaagcagcttcagcagactgacctggttcagaaagcagagaaaggccgtggtgagcaccagcgacaagaagatgcccaacggcatcctggaggagcaggagcagcagagagtgatgctgctgagcagaagccccagcggccccaagaagtacttccccatccccgtggagcacctggaggaggagatcagaatcagaagcgccgacgactgcaagcagttcagagaggagttcaacagcctgcccagcggccacatccagggcaccttcgagctggccaacaaggaggagaacagagagaagaacagataccccaacatcctgcccaacgaccacagcagagtgatcctgagccagctggacggcatcccctgcagcgactacatcaacgccagctacatcgacggctacaaggagaagaacaagttcatcgccgcccagggccccaagcaggagaccgtgaacgacttctggagaatggtgtgggagcagaagagcgccaccatcgtgatgctgaccaacctgaaggagagaaaggaggagaagtgccaccagtactggcccgaccagggctgctggacctacggcaacatcagagtgtgcgtggaggactgcgtggtgctggtggactacaccatcagaaagttctgcatccagccccagctgcccgacggctgcaaggcccccagactggtgagccagctgcacttcaccagctggcccgacttcggcgtgcccttcacccccatcggcatgctgaagttcctgaagaaggtgaagaccctgaaccccgtgcacgccggccccatcgtggtgcactgcagcgccggcgtgggcagaaccggcaccttcatcgtgatcgacgccatgatggccatgatgcacgccgagcagaaggtggacgtgttcgagttcgtgagcagaatcagaaaccagagaccccagatggtgcagaccgacatgcagtacaccttcatctaccaggccctgctggagtactacctgtacggcgacaccgagctggacgtgagcagcctggagaagcacctgcagaccatgcacggcaccaccacccacttcgacaagatcggcctggaggaggagttcagaaagctgaccaacgtgagaatcatgaaggagaacatgagaaccggcaacctgcccgccaacatgaagaaggccagagtgatccagatcatcccctacgacttcaacagagtgatcctgagcatgaagagaggccaggagtacaccgactacatcaacgccagcttcatcgacggctacagacagaaggactacttcatcgccacccagggccccctggcccacaccgtggaggacttctggagaatgatctgggagtggaagagccacaccatcgtgatgctgaccgaggtgcaggagagagagcaggacaagtgctaccagtactggcccaccgagggcagcgtgacccacggcgagatcaccatcgagatcaagaacgacaccctgagcgaggccatcagcatcagagacttcctggtgaccctgaaccagccccaggccagacaggaggagcaggtgagagtggtgagacagttccacttccacggctggcccgagatcggcatccccgccgagggcaagggcatgatcgacctgatcgccgccgtgcagaagcagcagcagcagaccggcaaccaccccatcaccgtgcactgcagcgccggcgccggcagaaccggcaccttcatcgccctgagcaacatcctggagagagtgaaggccgagggcctgctggacgtgttccaggccgtgaagagcctgagactgcagagaccccacatggtgcagaccctggagcagtacgagttctgctacaaggtggtgcaggacttcatcgacatcttcagcgactacgccaacttcaagtag

SEQ ID NO: 95530 - DNA, 2103 bp, Artificial Sequence; identical to SEQ ID NO: 95528
  Description of Artificial Sequence: Synthetic coding sequence

SEQ ID NO: 95531 - DNA, 438 bp, Artificial Sequence
  Description of Artificial Sequence: Synthetic coding sequence
atggagcccctgtgccccctgctgctggtgggcttcagcctgcccctggccagagccctgagaggcaacgagaccaccgccgacagcaacgagaccaccaccaccagcggcccccccgaccccggcgccagccagcccctgctggcctggctgctgctgcccctgctgctgctgctgctggtgctgctgctggccgcctacttcttcagattcagaaagcagagaaaggccgtggtgagcaccagcgacaagaagatgcccaacggcatcctggaggagcaggagcagcagagagtgatgctgctgagcagaagccccagcggccccaagaagtacttccccatccccgtggagcacctggaggaggagatcagaatcagaagcgccgacgactgcaagcagttcagagaggagttcaacatgaccatcctgggctag

SEQ ID NO: 95532 - DNA, 2010 bp, Artificial Sequence
  Description of Artificial Sequence: Synthetic coding sequence
atggtgagccagagactgcccagaaagaccagaggccccccctggagcccctgcgtgcacagctgctggtgggtgctggcctgcagaagccccggcctgagcggcgccaccagacccctgcccaccgccaccagacagcccagaccccaggccctgagaaccagagccccccccagcagatgctggcccggctgctactgcagatgctgcagcagcagcagctgcagcttcagcccccccaccagcagcggcagcggccccaagaagtacttccccatccccgtggagcacctggaggaggagatcagaatcagaagcgccgacgactgcaagcagttcagagaggagttcaacagcctgcccagcggccacatccagggcaccttcgagctggccaacaaggaggagaacagagagaagaacagataccccaacatcctgcccaacgaccacagcagagtgatcctgagccagctggacggcatcccctgcagcgactacatcaacgccagctacatcgacggctacaaggagaagaacaagttcatcgccgcccagggccccaagcaggagaccgtgaacgacttctggagaatggtgtgggagcagaagagcgccaccatcgtgatgctgaccaacctgaaggagagaaaggaggagaagtgccaccagtactggcccgaccagggctgctggacctacggcaacatcagagtgtgcgtggaggactgcgtggtgctggtggactacaccatcagaaagttctgcatccagccccagctgcccgacggctgcaaggcccccagactggtgagccagctgcacttcaccagctggcccgacttcggcgtgcccttcacccccatcggcatgctgaagttcctgaagaaggtgaagaccctgaaccccgtgcacgccggccccatcgtggtgcactgcagcgccggcgtgggcagaaccggcaccttcatcgtgatcgacgccatgatggccatgatgcacgccgagcagaaggtggacgtgttcgagttcgtgagcagaatcagaaaccagagaccccagatggtgcagaccgacatgcagtacaccttcatctaccaggccctgctggagtactacctgtacggcgacaccgagctggacgtgagcagcctggagaagcacctgcagaccatgcacggcaccaccacccacttcgacaagatcggcctggaggaggagttcagaaagctgaccaacgtgagaatcatgaaggagaacatgagaaccggcaacctgcccgccaacatgaagaaggccagagtgatccagatcatcccctacgacttcaacagagtgatcctgagcatgaagagaggccaggagtacaccgactacatcaacgccagcttcatcgacggctacagacagaaggactacttcatcgccacccagggccccctggcccacaccgtggaggacttctggagaatgatctgggagtggaagagccacaccatcgtgatgctgaccgaggtgcaggagagagagcaggacaagtgctaccagtactggcccaccgagggcagcgtgacccacggcgagatcaccatcgagatcaagaacgacaccctgagcgaggccatcagcatcagagacttcctggtgaccctgaaccagccccaggccagacaggaggagcaggtgagagtggtgagacagttccacttccacggctggcccgagatcggcatccccgccgagggcaagggcatgatcgacctgatcgccgccgtgcagaagcagcagcagcagaccggcaaccaccccatcaccgtgcactgcagaaacagcatgaacagcgccaccaagtggtacaagatcctgctgatctacttcctgatcatgctgatcagcaacgaggacagctgcctgaagatcttcttcaacctgatggagcagagaagaagccacttcccccaggacgccagactgagcccccccctgagcggcaccgccttcgccctgtag

SEQ ID NO: 95533 - DNA, 423 bp, Artificial Sequence
  Description of Artificial Sequence: Synthetic coding sequence
atggagcccctgtgccccctgctgctggtgggcttcagcctgcccctggccagagccctgagaggcaacgagaccaccgccgacagcaacgagaccaccaccaccagcggcccccccgaccccggcgccagccagcccctgctggcctggctgctgctgcccctgctgctgctgctgctggtgctgctgctggccgcctacttcttcagattcagaaagcagagaaaggccgtggtgagcaccagcgacaagaagatgcccaacggcatcctggaggagcaggagcagcagagagtgatgctgctgagcagaagccccagcggccccaagaagtacttccccatccccgtggagcacctggaggaggagatcagaatcagaagcgccgacgactgcaagcagttcagagaggagttcaactag

SEQ ID NO: 95534 - DNA, 465 bp, Artificial Sequence
  Description of Artificial Sequence: Synthetic coding sequence
atggagcccctgtgccccctgctgctggtgggcttcagcctgcccctggccagagccctgagaggcaacgagaccaccgccgacagcaacgagaccaccaccaccagcggcccccccgaccccggcgccagccagcccctgctggcctggctgctgctgcccctgctgctgctgctgctggtgctgctgctggccgcctacttcttcagattcagaaagcagagaaaggccgtggtgagcaccagcgacaagaagatgcccaacggcatcctggaggagcaggagcagcagagagtgatgctgctgagcagaagccccagcggccccaagaagtacttccccatccccgtggagcacctggaggaggagatcagaatcagaagcgccgacgactgcaagcagttcagagaggagttcaacagcctgcccagcggccacatccagggcaccttcgagctggcctag

SEQ ID NO: 95535 - DNA, 5724 bp, Artificial Sequence
  Description of Artificial Sequence: Synthetic coding sequence
atggcccccgagcccgcccccggcagaaccatggtgcccctggtgcccgccctggtgatgctgggcctggtggccggcgcccacggcgacagcaagcccgtgttcatcaaggtgcccgaggaccagaccggcctgagcggcggcgtggccagcttcgtgtgccaggccaccggcgagcccaagcccagaatcacctggatgaagaagggcaagaaggtgagcagccagagattcgaggtgatcgagttcgacgacggcgccggcagcgtgctgagaatccagcccctgagagtgcagagagacgaggccatctacgagtgcaccgccaccaacagcctgggcgagatcaacaccagcgccaagctgagcgtgctggaggaggagcagctgccccccggcttccccagcatcgacatgggcccccagctgaaggtggtggagaaggccagaaccgccaccatgctgtgcgccgccggcggcaaccccgaccccgagatcagctggttcaaggacttcctgcccgtggaccccgccaccagcaacggcagaatcaagcagctgagaagcggcgccctgcagatcgagagcagcgaggagagcgaccagggcaagtacgagtgcgtggccaccaacagcgccggcaccagatacagcgcccccgccaacctgtacgtgagagtgagaagagtggcccccagattcagcatcccccccagcagccaggaggtgatgcccggcggcagcgtgaacctgacctgcgtggccgtgggcgcccccatgccctacgtgaagtggatgatgggcgccgaggagctgaccaaggaggacgagatgcccgtgggcagaaacgtgctggagctgagcaacgtggtgagaagcgccaactacacctgcgtggccatcagcagcctgggcatgatcgaggccaccgcccaggtgaccgtgaaggccctgcccaagccccccatcgacctggtggtgaccgagaccaccgccaccagcgtgaccctgacctgggacagcggcaacagcgagcccgtgacctactacggcatccagtacagagccgccggcaccgagggccccttccaggaggtggacggcgtggccaccaccagatacagcatcggcggcctgagccccttcagcgagtacgccttcagagtgctggccgtgaacagcatcggcagaggcccccccagcgaggccgtgagagccagaaccggcgagcaggcccccagcagcccccccagaagagtgcaggccagaatgctgagcgccagcaccatgctggtgcagtgggagccccccgaggagcccaacggcctggtgagaggctacagagtgtactacacccccgacagcagaagaccccccaacgcctggcacaagcacaacaccgacgccggcctgctgaccaccgtgggcagcctgctgcccggcatcacctacagcctgagagtgctggccttcaccgccgtgggcgacggcccccccagccccaccatccaggtgaagacccagcagggcgtgcccgcccagcccgccgacttccaggccgaggtggagagcgacaccagaatccagctgagctggctgctgcccccccaggagagaatcatcatgtacgagctggtgtactgggccgccgaggacgaggaccagcagcacaaggtgaccttcgaccccaccagcagctacaccctggaggacctgaagcccgacaccctgtacagattccagctggccgccagaagcgacatgggcgtgggcgtgttcacccccaccatcgaggccagaaccgcccagagcacccccagcgcccccccccagaaggtgatgtgcgtgagcatgggcagcaccaccgtgagagtgagctgggtgcccccccccgccgacagcagaaacggcgtgatcacccagtacagcgtggcctacgaggccgtggacggcgaggacagaggcagacacgtggtggacggcatcagcagagagcacagcagctgggacctggtgggcctggagaagtggaccgagtacagagtgtgggtgagagcccacaccgacgtgggccccggccccgagagcagccccgtgctggtgagaaccgacgaggacgtgcccagcggcccccccagaaaggtggaggtggagcccctgaacagcaccgccgtgcacgtgtactggaagctgcccgtgcccagcaagcagcacggccagatcagaggctaccaggtgacctacgtgagactggagaacggcgagcccagaggcctgcccatcatccaggacgtgatgctggccgaggcccagtggagacccgaggagagcgaggactacgagaccaccatcagcggcctgacccccgagaccacctacagcgtgaccgtggccgcctacaccaccaagggcgacggcgccagaagcaagcccaagatcgtgaccaccaccggcgccgtgcccggcagacccaccatgatgatcagcaccaccgccatgaacaccgccctgctgcagtggcacccccccaaggagctgcccggcgagctgctgggctacagactgcagtactgcagagccgacgaggccagacccaacaccatcgacttcggcaaggacgaccagcacttcaccgtgaccggcctgcacaagggcaccacctacatcttcagactggccgccaagaacagagccggcctgggcgaggagttcgagaaggagatcagaacccccgaggacctgcccagcggcttcccccagaacctgcacgtgaccggcctgaccaccagcaccaccgagctggcctgggacccccccgtgctggccgagagaaacggcagaatcatcagctacaccgtggtgttcagagacatcaacagccagcaggagctgcagaacatcaccaccgacaccagattcaccctgaccggcctgaagcccgacaccacctacgacatcaaggtgagagcctggaccagcaagggcagcggccccctgagccccagcatccagagcagaaccatgcccgtggagcaggtgttcgccaagaacttcagagtggccgccgccatgaagaccagcgtgctgctgagctgggaggtgcccgacagctacaagagcgccgtgcccttcaagatcctgtacaacggccagagcgtggaggtggacggccacagcatgagaaagctgatcgccgacctgcagcccaacaccgagtacagcttcgtgctgatgaacagaggcagcagcgccggcggcctgcagcacctggtgagcatcagaaccgcccccgacctgctgccccacaagcccctgcccgccagcgcctacatcgaggacggcagattcgacctgagcatgccccacgtgcaggaccccagcctggtgagatggttctacatcgtggtggtgcccatcgacagagtgggcggcagcatgctgacccccagatggagcacccccgaggagctggagctggacgagctgctggaggccatcgagcagggcggcgaggagcagagaagaagaagaagacaggccgagagactgaagccctacgtggccgcccagctggacgtgctgcccgagaccttcaccctgggcgacaagaagaactacagaggcttctacaacagacccctgagccccgacctgagctaccagtgcttcgtgctggccagcctgaaggagcccatggaccagaagagatacgccagcagcccctacagcgacgagatcgtggtgcaggtgacccccgcccagcagcaggaggagcccgagatgctgtgggtgaccggccccgtgctggccgtgatcctgatcatcctgatcgtgatcgccatcctgctgttcaagagaaagagaacccacagccccagcagcaaggacgagcagagcatcggcctgaaggacagcctgctggcccacagcagcgaccccgtggagatgagaagactgaactaccagacccccggcatgagagaccacccccccatccccatcaccgacctggccgacaacatcgagagactgaaggccaacgacggcctgaagttcagccaggagtacgagagcatcgaccccggccagcagttcacctgggagaacagcaacctggaggtgaacaagcccaagaacagatacgccaacgtgatcgcctacgaccacagcagagtgatcctgaccagcatcgacggcgtgcccggcagcgactacatcaacgccaactacatcgacggctacagaaagcagaacgcctacatcgccacccagggccccctgcccgagaccatgggcgacttctggagaatggtgtgggagcagagaaccgccaccgtggtgatgatgaccagactggaggagaagagcagagtgaagtgcgaccagtactggcccgccagaggcaccgagacctgcggcctgatccaggtgaccctgctggacaccgtggagctggccacctacaccgtgagaaccttcgccctgcacaagagcggcagcagcgagaagagagagctgagacagttccagttcatggcctggcccgaccacggcgtgcccgagtaccccacccccatcctggccttcctgagaagagtgaaggcctgcaaccccctggacgccggccccatggtggtgcactgcagcgccggcgtgggcagaaccggctgcttcatcgtgatcgacgccatgctggagagaatgaagcacgagaagaccgtggacatctacggccacgtgacctgcatgagaagccagagaaactacatggtgcagaccgaggaccagtacgtgttcatccacgaggccctgctggaggccgccacctgcggccacaccgaggtgcccgccagaaacctgtacgcccacatccagaagctgggccaggtgccccccggcgagagcgtgaccgccatggagctggagttcaagctgctggccagcagcaaggcccacaccagcagattcatcagcgccaacctgccctgcaacaagttcaagaacagactggtgaacatcatgccctacgagctgaccagagtgtgcctgcagcccatcagaggcgtggagggcagcgactacatcaacgccagcttcctggacggctacagacagcagaaggcctacatcgccacccagggccccctggccgagagcaccgaggacttctggagaatgctgtgggagcacaacagcaccatcatcgtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccatcagacagttccagttcaccgactggcccgagcagggcgtgcccaagaccggcgagggcttcatcgacttcatcggccaggtgcacaagaccaaggagcagttcggccaggacggccccatcaccgtgcactgcagcgccggcgtgggcagaaccggcgtgttcatcaccctgagcatcgtgctggagagaatgagatacgagggcgtggtggacatgttccagaccgtgaagaccctgagaacccagagacccgccatggtgcagaccgaggaccagtaccagctgtgctacagagccgccctggagtacctgggcagcttcgaccactacgccacctag

SEQ ID NO: 95536 - DNA, 5697 bp, Artificial Sequence
  Description of Artificial Sequence: Synthetic coding sequence
atggcccccgagcccgcccccggcagaaccatggtgcccctggtgcccgccctggtgatgctgggcctggtggccggcgcccacggcgacagcaagcccgtgttcatcaaggtgcccgaggaccagaccggcctgagcggcggcgtggccagcttcgtgtgccaggccaccggcgagcccaagcccagaatcacctggatgaagaagggcaagaaggtgagcagccagagattcgaggtgatcgagttcgacgacggcgccggcagcgtgctgagaatccagcccctgagagtgcagagagacgaggccatctacgagtgcaccgccaccaacagcctgggcgagatcaacaccagcgccaagctgagcgtgctggaggaggagcagctgccccccggcttccccagcatcgacatgggcccccagctgaaggtggtggagaaggccagaaccgccaccatgctgtgcgccgccggcggcaaccccgaccccgagatcagctggttcaaggacttcctgcccgtggaccccgccaccagcaacggcagaatcaagcagctgagaagcggcgccctgcagatcgagagcagcgaggagagcgaccagggcaagtacgagtgcgtggccaccaacagcgccggcaccagatacagcgcccccgccaacctgtacgtgagagtgagaagagtggcccccagattcagcatcccccccagcagccaggaggtgatgcccggcggcagcgtgaacctgacctgcgtggccgtgggcgcccccatgccctacgtgaagtggatgatgggcgccgaggagctgaccaaggaggacgagatgcccgtgggcagaaacgtgctggagctgagcaacgtggtgagaagcgccaactacacctgcgtggccatcagcagcctgggcatgatcgaggccaccgcccaggtgaccgtgaaggccctgcccaagccccccatcgacctggtggtgaccgagaccaccgccaccagcgtgaccctgacctgggacagcggcaacagcgagcccgtgacctactacggcatccagtacagagccgccggcaccgagggccccttccaggaggtggacggcgtggccaccaccagatacagcatcggcggcctgagccccttcagcgagtacgccttcagagtgctggccgtgaacagcatcggcagaggcccccccagcgaggccgtgagagccagaaccggcgagcaggcccccagcagcccccccagaagagtgcaggccagaatgctgagcgccagcaccatgctggtgcagtgggagccccccgaggagcccaacggcctggtgagaggctacagagtgtactacacccccgacagcagaagaccccccaacgcctggcacaagcacaacaccgacgccggcctgctgaccaccgtgggcagcctgctgcccggcatcacctacagcctgagagtgctggccttcaccgccgtgggcgacggcccccccagccccaccatccaggtgaagacccagcagggcgtgcccgcccagcccgccgacttccaggccgaggtggagagcgacaccagaatccagctgagctggctgctgcccccccaggagagaatcatcatgtacgagctggtgtactgggccgccgaggacgaggaccagcagcacaaggtgaccttcgaccccaccagcagctacaccctggaggacctgaagcccgacaccctgtacagattccagctggccgccagaagcgacatgggcgtgggcgtgttcacccccaccatcgaggccagaaccgcccagagcacccccagcgcccccccccagaaggtgatgtgcgtgagcatgggcagcaccaccgtgagagtgagctgggtgcccccccccgccgacagcagaaacggcgtgatcacccagtacagcgtggcctacgaggccgtggacggcgaggacagaggcagacacgtggtggacggcatcagcagagagcacagcagctgggacctggtgggcctggagaagtggaccgagtacagagtgtgggtgagagcccacaccgacgtgggccccggccccgagagcagccccgtgctggtgagaaccgacgaggacgtgcccagcggcccccccagaaaggtggaggtggagcccctgaacagcaccgccgtgcacgtgtactggaagctgcccgtgcccagcaagcagcacggccagatcagaggctaccaggtgacctacgtgagactggagaacggcgagcccagaggcctgcccatcatccaggacgtgatgctggccgaggcccaggagaccaccatcagcggcctgacccccgagaccacctacagcgtgaccgtggccgcctacaccaccaagggcgacggcgccagaagcaagcccaagatcgtgaccaccaccggcgccgtgcccggcagacccaccatgatgatcagcaccaccgccatgaacaccgccctgctgcagtggcacccccccaaggagctgcccggcgagctgctgggctacagactgcagtactgcagagccgacgaggccagacccaacaccatcgacttcggcaaggacgaccagcacttcaccgtgaccggcctgcacaagggcaccacctacatcttcagactggccgccaagaacagagccggcctgggcgaggagttcgagaaggagatcagaacccccgaggacctgcccagcggcttcccccagaacctgcacgtgaccggcctgaccaccagcaccaccgagctggcctgggacccccccgtgctggccgagagaaacggcagaatcatcagctacaccgtggtgttcagagacatcaacagccagcaggagctgcagaacatcaccaccgacaccagattcaccctgaccggcctgaagcccgacaccacctacgacatcaaggtgagagcctggaccagcaagggcagcggccccctgagccccagcatccagagcagaaccatgcccgtggagcaggtgttcgccaagaacttcagagtggccgccgccatgaagaccagcgtgctgctgagctgggaggtgcccgacagctacaagagcgccgtgcccttcaagatcctgtacaacggccagagcgtggaggtggacggccacagcatgagaaagctgatcgccgacctgcagcccaacaccgagtacagcttcgtgctgatgaacagaggcagcagcgccggcggcctgcagcacctggtgagcatcagaaccgcccccgacctgctgccccacaagcccctgcccgccagcgcctacatcgaggacggcagattcgacctgagcatgccccacgtgcaggaccccagcctggtgagatggttctacatcgtggtggtgcccatcgacagagtgggcggcagcatgctgacccccagatggagcacccccgaggagctggagctggacgagctgctggaggccatcgagcagggcggcgaggagcagagaagaagaagaagacaggccgagagactgaagccctacgtggccgcccagctggacgtgctgcccgagaccttcaccctgggcgacaagaagaactacagaggcttctacaacagacccctgagccccgacctgagctaccagtgcttcgtgctggccagcctgaaggagcccatggaccagaagagatacgccagcagcccctacagcgacgagatcgtggtgcaggtgacccccgcccagcagcaggaggagcccgagatgctgtgggtgaccggccccgtgctggccgtgatcctgatcatcctgatcgtgatcgccatcctgctgttcaagagaaagagaacccacagccccagcagcaaggacgagcagagcatcggcctgaaggacagcctgctggcccacagcagcgaccccgtggagatgagaagactgaactaccagacccccggcatgagagaccacccccccatccccatcaccgacctggccgacaacatcgagagactgaaggccaacgacggcctgaagttcagccaggagtacgagagcatcgaccccggccagcagttcacctgggagaacagcaacctggaggtgaacaagcccaagaacagatacgccaacgtgatcgcctacgaccacagcagagtgatcctgaccagcatcgacggcgtgcccggcagcgactacatcaacgccaactacatcgacggctacagaaagcagaacgcctacatcgccacccagggccccctgcccgagaccatgggcgacttctggagaatggtgtgggagcagagaaccgccaccgtggtgatgatgaccagactggaggagaagagcagagtgaagtgcgaccagtactggcccgccagaggcaccgagacctgcggcctgatccaggtgaccctgctggacaccgtggagctggccacctacaccgtgagaaccttcgccctgcacaagagcggcagcagcgagaagagagagctgagacagttccagttcatggcctggcccgaccacggcgtgcccgagtaccccacccccatcctggccttcctgagaagagtgaaggcctgcaaccccctggacgccggccccatggtggtgcactgcagcgccggcgtgggcagaaccggctgcttcatcgtgatcgacgccatgctggagagaatgaagcacgagaagaccgtggacatctacggccacgtgacctgcatgagaagccagagaaactacatggtgcagaccgaggaccagtacgtgttcatccacgaggccctgctggaggccgccacctgcggccacaccgaggtgcccgccagaaacctgtacgcccacatccagaagctgggccaggtgccccccggcgagagcgtgaccgccatggagctggagttcaagctgctggccagcagcaaggcccacaccagcagattcatcagcgccaacctgccctgcaacaagttcaagaacagactggtgaacatcatgccctacgagctgaccagagtgtgcctgcagcccatcagaggcgtggagggcagcgactacatcaacgccagcttcctggacggctacagacagcagaaggcctacatcgccacccagggccccctggccgagagcaccgaggacttctggagaatgctgtgggagcacaacagcaccatcatcgtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccatcagacagttccagttcaccgactggcccgagcagggcgtgcccaagaccggcgagggcttcatcgacttcatcggccaggtgcacaagaccaaggagcagttcggccaggacggccccatcaccgtgcactgcagcgccggcgtgggcagaaccggcgtgttcatcaccctgagcatcgtgctggagagaatgagatacgagggcgtggtggacatgttccagaccgtgaagaccctgagaacccagagacccgccatggtgcagaccgaggaccagtaccagctgtgctacagagccgccctggagtacctgggcagcttcgaccactacgccacctag

SEQ ID NO: 95537 - DNA, 5724 bp, Artificial Sequence; identical to SEQ ID NO: 95535
  Description of Artificial Sequence: Synthetic coding sequence

SEQ ID NO: 95538 - DNA, 3801 bp, Artificial Sequence
  Description of Artificial Sequence: Synthetic coding sequence
atgtacgagctggtgtactgggccgccgaggacgaggaccagcagcacaaggtgaccttcgaccccaccagcagctacaccctggaggacctgaagcccgacaccctgtacagattccagctggccgccagaagcgacatgggcgtgggcgtgttcacccccaccatcgaggccagaaccgcccagagcatgcccagcggcccccccagaaaggtggaggtggagcccctgaacagcaccgccgtgcacgtgtactggaagctgcccgtgcccagcaagcagcacggccagatcagaggctaccaggtgacctacgtgagactggagaacggcgagcccagaggcctgcccatcatccaggacgtgatgctggccgaggcccaggagaccaccatcagcggcctgacccccgagaccacctacagcgtgaccgtggccgcctacaccaccaagggcgacggcgccagaagcaagcccaagatcgtgaccaccaccggcgccgtgcccggcagacccaccatgatgatcagcaccaccgccatgaacaccgccctgctgcagtggcacccccccaaggagctgcccggcgagctgctgggctacagactgcagtactgcagagccgacgaggccagacccaacaccatcgacttcggcaaggacgaccagcacttcaccgtgaccggcctgcacaagggcaccacctacatcttcagactggccgccaagaacagagccggcctgggcgaggagttcgagaaggagatcagaacccccgaggacctgcccagcggcttcccccagaacctgcacgtgaccggcctgaccaccagcaccaccgagctggcctgggacccccccgtgctggccgagagaaacggcagaatcatcagctacaccgtggtgttcagagacatcaacagccagcaggagctgcagaacatcaccaccgacaccagattcaccctgaccggcctgaagcccgacaccacctacgacatcaaggtgagagcctggaccagcaagggcagcggccccctgagccccagcatccagagcagaaccatgcccgtggagcaggtgttcgccaagaacttcagagtggccgccgccatgaagaccagcgtgctgctgagctgggaggtgcccgacagctacaagagcgccgtgcccttcaagatcctgtacaacggccagagcgtggaggtggacggccacagcatgagaaagctgatcgccgacctgcagcccaacaccgagtacagcttcgtgctgatgaacagaggcagcagcgccggcggcctgcagcacctggtgagcatcagaaccgcccccgacctgctgccccacaagcccctgcccgccagcgcctacatcgaggacggcagattcgacctgagcatgccccacgtgcaggaccccagcctggtgagatggttctacatcgtggtggtgcccatcgacagagtgggcggcagcatgctgacccccagatggagcacccccgaggagctggagctggacgagctgctggaggccatcgagcagggcggcgaggagcagagaagaagaagaagacaggccgagagactgaagccctacgtggccgcccagctggacgtgctgcccgagaccttcaccctgggcgacaagaagaactacagaggcttctacaacagacccctgagccccgacctgagctaccagtgcttcgtgctggccagcctgaaggagcccatggaccagaagagatacgccagcagcccctacagcgacgagatcgtggtgcaggtgacccccgcccagcagcaggaggagcccgagatgctgtgggtgaccggccccgtgctggccgtgatcctgatcatcctgatcgtgatcgccatcctgctgttcaagagaaagagaacccacagccccagcagcaaggacgagcagagcatcggcctgaaggacagcctgctggcccacagcagcgaccccgtggagatgagaagactgaactaccagacccccggcagcagcgtgcccagctgccccaacaccagcagcatgagagaccacccccccatccccatcaccgacctggccgacaacatcgagagactgaaggccaacgacggcctgaagttcagccaggagtacgagagcatcgaccccggccagcagttcacctgggagaacagcaacctggaggtgaacaagcccaagaacagatacgccaacgtgatcgcctacgaccacagcagagtgatcctgaccagcatcgacggcgtgcccggcagcgactacatcaacgccaactacatcgacggctacagaaagcagaacgcctacatcgccacccagggccccctgcccgagaccatgggcgacttctggagaatggtgtgggagcagagaaccgccaccgtggtgatgatgaccagactggaggagaagagcagagtgaagtgcgaccagtactggcccgccagaggcaccgagacctgcggcctgatccaggtgaccctgctggacaccgtggagctggccacctacaccgtgagaaccttcgccctgcacaagagcggcagcagcgagaagagagagctgagacagttccagttcatggcctggcccgaccacggcgtgcccgagtaccccacccccatcctggccttcctgagaagagtgaaggcctgcaaccccctggacgccggccccatggtggtgcactgcagcgccggcgtgggcagaaccggctgcttcatcgtgatcgacgccatgctggagagaatgaagcacgagaagaccgtggacatctacggccacgtgacctgcatgagaagccagagaaactacatggtgcagaccgaggaccagtacgtgttcatccacgaggccctgctggaggccgccacctgcggccacaccgaggtgcccgccagaaacctgtacgcccacatccagaagctgggccaggtgccccccggcgagagcgtgaccgccatggagctggagttcaagctgctggccagcagcaaggcccacaccagcagattcatcagcgccaacctgccctgcaacaagttcaagaacagactggtgaacatcatgccctacgagctgaccagagtgtgcctgcagcccatcagaggcgtggagggcagcgactacatcaacgccagcttcctggacggctacagacagcagaaggcctacatcgccacccagggccccctggccgagagcaccgaggacttctggagaatgctgtgggagcacaacagcaccatcatcgtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccatcagacagttccagttcaccgactggcccgagcagggcgtgcccaagaccggcgagggcttcatcgacttcatcggccaggtgcacaagaccaaggagcagttcggccaggacggccccatcaccgtgcactgcagcgccggcgtgggcagaaccggcgtgttcatcaccctgagcatcgtgctggagagaatgagatacgagggcgtggtggacatgttccagaccgtgaagaccctgagaacccagagacccgccatggtgcagaccgaggaccagtaccagctgtgctacagagccgccctggagtacctgggcagcttcgaccactacgccacctag

SEQ ID NO: 95539 - DNA, 5697 bp, Artificial Sequence; identical to SEQ ID NO: 95536
  Description of Artificial Sequence: Synthetic coding sequence

SEQ ID NO: 95540 - DNA, 3609 bp, Artificial Sequence
  Description of Artificial Sequence: Synthetic coding sequence
atgatgtgcgaggtgatgcccaccatcagcgaggccgagggcccccccggcggcggcggcggccacggcagcggcagccccagccagcccgacgccgacagccacttcgagcagctgatggtgagcatgctggaggagagagacagactgctggacaccctgagagagacccaggagaccctggccctgacccagggcaagctgcacgaggtgggccacgagagagacagcctgcagagacagctgaacaccgccctgccccaggagttcgccgccctgaccaaggagctgaacgtgtgcagagagcagctgctggagagagaggaggagatcgccgagctgaaggccgagagaaacaacaccagactgctgctggagcacctggagtgcctggtgagcagacacgagagaagcctgagaatgaccgtggtgaagagacaggcccagagccccgccggcgtgagcagcgaggtggaggtgctgaaggccctgaagagcctgttcgagcaccacaaggccctggacgagaaggtgagagagagactgagagtggccctggagagatgcagcctgctggaggaggagctgggcgccacccacaaggagctgatgatcctgaaggagcagaacaaccagaagaagaccctgaccgacggcgtgctggacatcaaccacgagcaggagaacacccccagcaccagcggcaagagaagcagcgacggcagcctgagccacgaggaggacctggccaaggtgatcgagctgcaggagatcatcagcaagcagagcagagagcagagccagatgaaggagagactggccagcctgagcagccacgtgaccgagctggaggaggacctggacaccgccagaaaggacctgatcaagagcgaggagatgaacaccaagctgcagagagacgtgagagaggccatggcccagaaggaggacatggaggagagaatcaccaccctggagaagagatacctggccgcccagagagaggccaccagcgtgcacgacctgaacgacaagctggagaacgagatcgccaacaaggacagcatgcacagacagaccgaggacaagaacagacagctgcaggagagactggagctggccgagcagaagctgcagcagaccctgagaaaggccgagaccctgcccgaggtggaggccgagctggcccagagagtggccgccctgagcaaggccgaggagagacacggcaacatcgaggagagactgagacagatggaggcccagctggaggagaagaaccaggagctgcagagagccagacagagagagaagatgaacgaggagcacaacaagagactgagcgacaccgtggacaagctgctgagcgagagcaacgagagactgcagctgcacctgaaggagagaatggccgccctggaggacaagaacagcctgctgagagaggtggagagcgccaagaagcagctggaggagacccagcacgacaaggaccagctggtgctgaacatcgaggccctgagagccgagctggaccacatgagactgagaggcgccagcctgcaccacggcagaccccacctgggcagcgtgcccgacttcagattccccatggccgacggccacaccgacagctacagcaccagcgccgtgctgagaagaccccagaagggcagactggccgccctgagagacgagcccagcaaggtgcagaccctgaacgagcaggactgggagagagcccagcaggccagcgtgctggccaacgtggcccaggccttcgagagcgacgccgacgtgagcgacggcgaggacgacagagacaccctgctgagcagcgtggacctgctgagccccagcggccaggccgacgcccacaccctggccatgatgctgcaggagcagctggacgccatcaacaaggagatcagactgatccaggaggagaaggagaacaccgagcagagagccgaggagatcgagagcagagtgggcagcggcagcctggacaacctgggcagattcagaagcatgagcagcatccccccctaccccgccagcagcctggccagcagcagcccccccggcagcggcagaagcacccccagaagaatcccccacagccccgccagagaggtggacagactgggcgtgatgaccctgctgccccccagcagagaggaggtgagagacgacaagaccaccatcaagtgcgagaccagcccccccagcagccccagagccctgagactggacagactgcacaagggcgccctgcacaccgtgagccacgaggacatcagagacatcagaaacagcaccggcagccaggacggccccgtgagcaaccccagcagcagcaacagcagccaggacagcctgcacaaggcccccaagaagaagggcatcaagagcagcatcggcagactgttcggcaagaaggagaagggcagacccggccagaccggcaaggaggccctgggccaggccggcgtgagcgagaccgacaacagcagccaggacgccctgggcctgagcaagctgggcggccaggccgagaagaacagaaagctgcagaagaagcacgagctgctggaggaggccagaagacagggcctgcccttcgcccagtgggacggccccaccgtggtggtgtggctggagctgtgggtgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatcatgagcctgaccagccccagcgccccccccaccagcagaaccaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagaggccagctgaagatggtggacagcttccacagaaacagcttccagtgcggcatcatgtgcctgagaagactgaactacgacagaaaggagctggagagaaagagagaggagagccagagcgagatcaaggacgtgctggtgtggagcaacgacagagtgatcagatggatcctgagcatcggcctgaaggagtacgccaacaacctgatcgagagcggcgtgcacggcgccctgctggccctggacgagaccttcgacttcagcgccctggccctgctgctgcagatccccacccagaacacccaggccagagccgtgctggagagagagttcaacaacctgctggtgatgggcaccgacagaagattcgacgaggacgacgacaagagcttcagaagagcccccagctggagaaagaagttcagacccaaggacatcagaggcctggccgccggcagcgccgagaccctgcccgccaacttcagagtgaccagcagcatgagcagccccagcatgcagcccaagaagatgcagatggacggcaacgtgagcggcacccagagactggacagcgccaccgtgagaacctacagctgctag

SEQ ID NO: 95541 - DNA, 3558 bp, Artificial Sequence
  Description of Artificial Sequence: Synthetic coding sequence
atgatgtgcgaggtgatgcccaccatcagcgaggccgagggcccccccggcggcggcggcggccacggcagcggcagccccagccagcccgacgccgacagccacttcgagcagctgatggtgagcatgctggaggagagagacagactgctggacaccctgagagagacccaggagaccctggccctgacccagggcaagctgcacgaggtgggccacgagagagacagcctgcagagacagctgaacaccgccctgccccaggagttcgccgccctgaccaaggagctgaacgtgtgcagagagcagctgctggagagagaggaggagatcgccgagctgaaggccgagagaaacaacaccagactgctgctggagcacctggagtgcctggtgagcagacacgagagaagcctgagaatgaccgtggtgaagagacaggcccagagccccgccggcgtgagcagcgaggtggaggtgctgaaggccctgaagagcctgttcgagcaccacaaggccctggacgagaaggtgagagagagactgagagtggccctggagagatgcagcctgctggaggaggagctgggcgccacccacaaggagctgatgatcctgaaggagcagaacaaccagaagaagaccctgaccgacggcgtgctggacatcaaccacgagcaggagaacacccccagcaccagcggcaagagaagcagcgacggcagcctgagccacgaggaggacctggccaaggtgatcgagctgcaggagatcatcagcaagcagagcagagagcagagccagatgaaggagagactggccagcctgagcagccacgtgaccgagctggaggaggacctggacaccgccagaaaggacctgatcaagagcgaggagatgaacaccaagctgcagagagacgtgagagaggccatggcccagaaggaggacatggaggagagaatcaccaccctggagaagagatacctggccgcccagagagaggccaccagcgtgcacgacctgaacgacaagctggagaacgagatcgccaacaaggacagcatgcacagacagaccgaggacaagaacagacagctgcaggagagactggagctggccgagcagaagctgcagcagaccctgagaaaggccgagaccctgcccgaggtggaggccgagctggcccagagagtggccgccctgagcaaggccgaggagagacacggcaacatcgaggagagactgagacagatggaggcccagctggaggagaagaaccaggagctgcagagagccagacagagagagaagatgaacgaggagcacaacaagagactgagcgacaccgtggacaagctgctgagcgagagcaacgagagactgcagctgcacctgaaggagagaatggccgccctggaggacaagaacagcctgctgagagaggtggagagcgccaagaagcagctggaggagacccagcacgacaaggaccagctggtgctgaacatcgaggccctgagagccgagctggaccacatgagactgagaggcgccagcctgcaccacggcagaccccacctgggcagcgtgcccgacttcagattccccatggccgacggccacaccgacagctacagcaccagcgccgtgctgagaagaccccagaagggcagactggccgccctgagagacgagcccagcaaggtgcagaccctgaacgagcaggactgggagagagcccagcaggccagcgtgctggccaacgtggcccaggccttcgagagcgacgccgacgtgagcgacggcgaggacgacagagacaccctgctgagcagcgtggacctgctgagccccagcggccaggccgacgcccacaccctggccatgatgctgcaggagcagctggacgccatcaacaaggagatcagactgatccaggaggagaaggagaacaccgagcagagagccgaggagatcgagagcagagtgggcagcggcagcctggacaacctgggcagattcagaagcatgagcagcatccccccctaccccgccagcagcctggccagcagcagcccccccggcagcggcagaagcacccccagaagaatcccccacagccccgccagagaggtggacagactgggcgtgatgaccctgctgccccccagcagagaggaggtgagagacgacaagaccaccatcaagtgcgagaccagcccccccagcagccccagagccctgagactggacagactgcacaagggcgccctgcacaccgtgagccacgaggacatcagagacatcagaaacagcaccggcagccaggacggccccgtgagcaaccccagcagcagcaacagcagccaggacagcctgcacaaggcccccaagaagaagggcatcaagagcagcatcggcagactgttcggcaagaaggagaagggcagacccggccagaccggcaaggaggccctgggccaggccggcgtgagcgagaccgacaacagcagccaggacgccctgggcctgagcaagctgggcggccaggccgagaagaacagaaagctgcagaagaagcacgagctgctggaggaggccagaagacagggcctgcccttcgcccagtgggacggccccaccgtggtggtgtggctggagctgtgggtgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatcatgagcctgaccagccccagcgccccccccaccagcagaaccaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagaggccagctgaagatggtggacagcttccacagaaacagcttccagtgcggcatcatgtgcctgagaagactgaactacgacagaaaggagctggagagaaagagagaggagagccagagcgagatcaaggacgtgctggtgtggagcaacgacagagtgatcagatggatcctgagcatcggcctgaaggagtacgccaacaacctgatcgagagcggcgtgcacggcgccctgctggccctggacgagaccttcgacttcagcgccctggccctgctgctgcagatccccacccagaacacccaggccagagccgtgctggagagagagttcaacaacctgctggtgatgggcaccgacagaagattcgacgaggacgacgacaagagcttcagaagagcccccagctggagaaagaagttcagacccaaggacatcagaggcctggccgccggcagcgccgagaccctgcccgccaacttcagagtgaccagcagcatgagcagccccagcatgcagcccaagaagatgcagatggacggcatgtag

SEQ ID NO: 95542 - DNA, 477 bp, Artificial Sequence
  Description of Artificial Sequence: Synthetic coding sequence
atgatgtgcgaggtgatgcccaccatcagcgaggccgagggcccccccggcggcggcggcggccacggcagcggcagccccagccagcccgacgccgacagccacttcgagcagctgatggtgagcatgctggaggagagagacagactgctggacaccctgagagagacccaggagaccctggccctgacccagggcaagctgcacgaggtgggccacgagagagacagcctgcagagacagctgaacaccgccctgccccaggagttcgccgccctgaccaaggagctgaacgtgtgcagagagcagctgctggagagagaggaggagatcgccgagctgaaggccgagagaaacaacaccagactgctgctggagcacctggagtgcctggtgagcagacacgagagaagcctgagaatgaccgtggtgaagagacaggcccagagccccgccggcgtgagcagcgaggtgtag

SEQ ID NO: 95543 - DNA, 300 bp, Artificial Sequence
  Description of Artificial Sequence: Synthetic coding sequence
atgatgtgcgaggtgatgcccaccatcagcgaggccgagggcccccccggcggcggcggcggccacggcagcggcagccccagccagcccgacgccgacagccacttcgagcagctgatggtgagcatgctggaggagagagacagactgctggacaccctgagagagacccaggagaccctggccctgacccagggcaagctgcacgaggtgggccacgagagagacagcctgcagagacagctgaacaccgccctgccccaggagttcgccgccctgaccaaggagctgaacgtgtag

SEQ ID NO: 95544 - DNA, 2100 bp, Artificial Sequence
  Description of Artificial Sequence: Synthetic coding sequence
atgagactgagaggcgccagcctgcaccacggcagaccccacctgggcagcgtgcccgacttcagattccccatggccgacggccacaccgacagctacagcaccagcgccgtgctgagaagaccccagaagggcagactggccgccctgagagacgagcccagcaaggtgcagaccctgaacgagcaggactgggagagagcccagcaggccagcgtgctggccaacgtggcccaggccttcgagagcgacgccgacgtgagcgacggcgaggacgacagagacaccctgctgagcagcgtggacctgctgagccccagcggccaggccgacgcccacaccctggccatgatgctgcaggagcagctggacgccatcaacaaggagatcagactgatccaggaggagaaggagaacaccgagcagagagccgaggagatcgagagcagagtgggcagcggcagcctggacaacctgggcagattcagaagcatgagcagcatccccccctaccccgccagcagcctggccagcagcagcccccccggcagcggcagaagcacccccagaagaatcccccacagccccgccagagaggtggacagactgggcgtgatgaccctgcccagcgacctgagaaagcacagaagaaagctgccccccagcagagaggaggtgagagacgacaagaccaccatcaagtgcgagaccagcccccccagcagccccagagccctgagactggacagactgcacaagggcgccctgcacaccgtgagccacgaggacatcagagacatcagaaacagcaccggcagccaggacggccccgtgagcaaccccagcagcagcaacagcagccaggacagcctgcacaaggcccccaagaagaagggcatcaagagcagcatcggcagactgttcggcaagaaggagaagggcagacccggccagaccggcaaggaggccctgggccaggccggcgtgagcgagaccgacaacagcagccaggacgccctgggcctgagcaagctgggcggccaggccgagaagaacagaaagctgcagaagaagcacgagctgctggaggaggccagaagacagggcctgcccttcgcccagtgggacggccccaccgtggtggtgtggctggagctgtgggtgggcatgcccgcctggtacgtggccgcctgcagagccaacgtgaagagcggcgccatcatgagcgccctgagcgacaccgagatccagagagagatcggcatcagcaaccccctgcacagactgaagctgagactggccatccaggagatcatgagcctgaccagccccagcgccccccccaccagcagaaccaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagaggccagctgaagatggtggacagcttccacagaaacagcttccagtgcggcatcatgtgcctgagaagactgaactacgacagaaaggagctggagagaaagagagaggagagccagagcgagatcaaggacgtgctggtgtggagcaacgacagagtgatcagatggatcctgagcatcggcctgaaggagtacgccaacaacctgatcgagagcggcgtgcacggcgccctgctggccctggacgagaccttcgacttcagcgccctggccctgctgctgcagatccccacccagaacacccaggccagagccgtgctggagagagagttcaacaacctgctggtgatgggcaccgacagaagattcgacgaggacgacgacaagagcttcagaagagcccccagctggagaaagaagttcagacccaaggacatcagaggcctggccgccggcagcgccgagaccctgcccgccaacttcagagtgaccagcagcatgagcagccccagcatgcagcccaagaagatgcagatggacggcaacgtgagcggcacccagagactggacagcgccaccgtgagaacctacagctgctag

SEQ ID NO: 95545 - DNA, 3585 bp, Artificial Sequence
  Description of Artificial Sequence: Synthetic coding sequence
atgatgtgcgaggtgatgcccaccatcagcgaggacggcagaagaggcagcgccctgggccccgacgaggccggcggcgagctggagagactgatggtgaccatgctgaccgagagagagagactgctggagaccctgagagaggcccaggacggcctggccaccgcccagctgagactgagagagctgggccacgagaaggacagcctgcagagacagctgagcatcgccctgccccaggagttcgccgccctgaccaaggagctgaacctgtgcagagagcagctgctggagagagaggaggagatcgccgagctgaaggccgagagaaacaacaccagactgctgctggagcacctggagtgcctggtgagcagacacgagagaagcctgagaatgaccgtggtgaagagacaggcccagagccccggcggcgtgagcagcgaggtggaggtgctgaaggccctgaagagcctgttcgagcaccacaaggccctggacgagaaggtgagagagagactgagaatggccctggagagagtggccgtgctggaggaggagctggagctgagcaaccaggagaccctgaacctgagagagcagctgagcagaagaagaagcggcctggaggagcccggcaaggacggcgacggccagaccctggccaacggcctgggccccggcggcgacagcaacagaagaaccgccgagctggaggaggccctggagagacagagagccgaggtgtgccagctgagagagagactggccgtgctgtgcagacagatgagccagctggaggaggagctgggcaccgcccacagagagctgggcaaggccgaggaggccaacagcaagctgcagagagacctgaaggaggccctggcccagagagaggacatggaggagagaatcaccaccctggagaagagatacctgagcgcccagagagaggccaccagcctgcacgacgccaacgacaagctggagaacgagctggccagcaaggagagcctgtacagacagagcgaggagaagagcagacagctggccgagtggctggacgacgccaagcagaagctgcagcagaccctgcagaaggccgagaccctgcccgagatcgaggcccagctggcccagagagtggccgccctgaacaaggccgaggagagacacggcaacttcgaggagagactgagacagctggaggcccagctggaggagaagaaccaggagctgcagagagccagacagagagagaagatgaacgacgaccacaacaagagactgagcgagaccgtggacaagctgctgagcgagagcaacgagagactgcagctgcacctgaaggagagaatgggcgccctggaggagaagaacagcctgagcgaggagatcgccaacatgaagaagctgcaggacgagctgctgctgaacaaggagcagctgctggccgagatggagagaatgcagatggagatcgaccagctgagaggcagaccccccagcagctacagcagaagcctgcccggcagcgccctggagctgagatacagccaggcccccaccctgcccagcggcgcccacctggacccctacgtggccggcagcggcagagccggcaagagaggcagatggagcggcgtgaaggaggagcccagcaaggactgggagagaagcgcccccgccggcagcatccccccccccttccccggcgagctggacggcagcgacgaggaggaggccgagggcatgttcggcgccgagctgctgagccccagcggccaggccgacgtgcagaccctggccatcatgctgcaggagcagctggaggccatcaacaaggagatcaagctgatccaggaggagaaggagaccaccgagcagagagccgaggagctggagagcagagtgagcagcagcggcctggacagcctgggcagatacagaagcagctgcagcctgccccccagcctgaccaccagcaccctggccagccccagcccccccagcagcggccacagcacccccagactggccccccccagccccgccagagagggcaccgacaaggccaaccacgtgcccaaggaggaggccggcgcccccagaggcgagggccccgccatccccggcgacacccccccccccacccccagaagcgccagactggagagaatgacccaggccctggccctgcaggccggcagcctggaggacggcggcccccccagaggcagcgagggcacccccgacagcctgcacaaggcccccaagaagaagagcatcaagagcagcatcggcagactgttcggcaagaaggagaagggcagaatgggcccccccggcagagacagcagcagcctggccggcacccccagcgacgagaccctggccaccgaccccctgggcctggccaagctgaccggccccggcgacaaggacagaagaaacaagagaaagcacgagctgctggaggaggcctgcagacagggcctgcccttcgccgcctgggacggccccaccgtggtgagctggctggagctgtgggtgggcatgcccgcctggtacgtggccgcctgcagagccaacgtgaagagcggcgccatcatggccaacctgagcgacaccgagatccagagagagatcggcatcagcaaccccctgcacagactgaagctgagactggccatccaggagatggtgagcctgaccagccccagcgcccccgccagcagcagaaccagcaccggcaacgtgtggatgacccacgaggagatggagagcctgaccgccaccaccaagcccgagaccaaggagatcagctgggagcagatcctggcctacggcgacatgaaccacgagtgggtgggcaacgactggctgcccagcctgggcctgccccagtacagaagctacttcatggagagcctggtggacgccagaatgctggaccacctgaacaagaaggagctgagaggccagctgaagatggtggacagcttccacagagtgagcctgcactacggcatcatgtgcctgaagagactgaactacgacagaaaggacctggagagaagaagagaggagagccagacccagatcagagacgtgatggtgtggagcaacgagagagtgatgggctgggtgagcggcctgggcctgaaggagttcgccaccaacctgaccgagagcggcgtgcacggcgccctgctggccctggacgagaccttcgactacagcgacctggccctgctgctgcagatccccacccagaacgcccaggccagacagctgctggagaaggagttcagcaacctgatcagcctgggcaccgacagaagactggacgaggacagcgccaagagcttcagcagaagccccagctggagaaagatgttcagagagaaggacctgagaggcgtgacccccgacagcgccgagatgctgccccccaacttcagaagcgccgccgccggcgccctgggcagccccggcctgcccctgagaaagctgcagcccgagggccagaccagcggcagcagcagagccgacggcgtgagcgtgagaacctacagctgctag

SEQ ID NO: 95546 - DNA, 1731 bp, Artificial Sequence
  Description of Artificial Sequence: Synthetic coding sequence
atgagcggccaggagttcgccgccctgaccaaggagctgaacctgtgcagagagcagctgctggagagagaggaggagatcgccgagctgaaggccgagagaaacaacaccagactgctgctggagcacctggagtgcctggtgagcagacacgagagaagcctgagaatgaccgtggtgaagagacaggcccagagccccggcggcgtgagcagcgaggtggaggtgctgaaggccctgaagagcctgttcgagcaccacaaggccctggacgagaaggtgagagagagactgagaatggccctggagagagtggccgtgctggaggaggagctggagctgagcaaccaggagaccctgaacctgagagagcagctgagcagaagaagaagcggcctggaggagcccggcaaggacggcgacggccagaccctggccaacggcctgggccccggcggcgacagcaacagaagaaccgccgagctggaggaggccctggagagacagagagccgaggtgtgccagctgagagagagactggccgtgctgtgcagacagatgagccagctggaggaggagctgggcaccgcccacagagagctgggcaaggccgaggaggccaacagcaagctgcagagagacctgaaggaggccctggcccagagagaggacatggaggagagaatcaccaccctggagaagagatacctgagcgcccagagagaggccaccagcctgcacgacgccaacgacaagctggagaacgagctggccagcaaggagagcctgtacagacagagcgaggagaagagcagacagctggccgagtggctggacgacgccaagcagaagctgcagcagaccctgcagaaggccgagaccctgcccgagatcgaggcccagctggcccagagagtggccgccctgaacaaggccgaggagagacacggcaacttcgaggagagactgagacagctggaggcccagctggaggagaagaaccaggagctgcagagagccagacagagagagaagatgaacgacgaccacaacaagagactgagcgagaccgtggacaagctgctgagcgagagcaacgagagactgcagctgcacctgaaggagagaatgggcgccctggaggagaagaacagcctgagcgaggagatcgccaacatgaagaagctgcaggacgagctgctgctgaacaaggagcagctgctggccgagatggagagaatgcagatggagatcgaccagctgagaggcagaccccccagcagctacagcagaagcctgcccggcagcgccctggagctgagatacagccaggcccccaccctgcccagcggcgcccacctggacccctacgtggccggcagcggcagagccggcaagagaggcagatggagcggcgtgaaggaggagcccagcaaggactgggagagaagcgcccccgccggcagcatccccccccccttccccggcgagctggacggcagcgacgaggaggaggccgagggcatgttcggcgccgagctgctgagccccagcggccaggccgacgtgcagaccctggccatcatgctgcaggagcagctggaggccatcaacaaggagatcaagatcatgagcctgagaagaaagctggagctgcacgagggcagaggcagacccagccaggagaccccccaccaccccctgcccgccctgcccgtgctgagagagtag

SEQ ID NO: 95547 - DNA, 4338 bp, Artificial Sequence
  Description of Artificial Sequence: Synthetic coding sequence
atgagaagactgctggagccctgctggtggatcctgttcctgaagatcaccagcagcgtgctgcactacgtggtgtgcttccccgccctgaccgagggctacgtgggcgccctgcacgagaacagacacggcagcgccgtgcagatcagaagaagaaaggccagcggcgacccctactgggcctacagcggcgcctacggccccgagcactgggtgaccagcagcgtgagctgcggcggcagacaccagagccccatcgacatcctggaccagtacgccagagtgggcgaggagtaccaggagctgcagctggacggcttcgacaacgagagcagcaacaagacctggatgaagaacaccggcaagaccgtggccatcctgctgaaggacgactacttcgtgagcggcgccggcctgcccggcagattcaaggccgagaaggtggagttccactggggccacagcaacggcagcgccggcagcgagcacagcatcaacggcagaagattccccgtggagatgcagatcttcttctacaaccccgacgacttcgacagcttccagaccgccatcagcgagaacagaatcatcggcgccatggccatcttcttccaggtgagccccagagacaacagcgccctggaccccatcatccacggcctgaagggcgtggtgcaccacgagaaggagaccttcctggaccccttcgtgctgagagacctgctgcccgccagcctgggcagctactacagatacaccggcagcctgaccacccccccctgcagcgagatcgtggagtggatcgtgttcagaagacccgtgcccatcagctaccaccagctggaggccttctacagcatcttcaccaccgagcagcaggaccacgtgaagagcgtggagtacctgagaaacaacttcagaccccagcagagactgcacgacagagtggtgagcaagagcgccgtgagagacagctggaaccacgacatgaccgacttcctggagaaccccctgggcaccgaggccagcaaggtgtgcagcagcccccccatccacatgaaggtgcagcccctgaaccagaccgccctgcaggtgagctggagccagcccgagaccatctaccacccccccatcatgaactacatgatcagctacagctggaccaagaacgaggacgagaaggagaagaccttcaccaaggacagcgacaaggacctgaaggccaccatcagccacgtgagccccgacagcctgtacctgttcagagtgcaggccgtgtgcagaaacgacatgagaagcgacttcagccagaccatgctgttccaggccaacaccaccagaatcttccagggcaccagaatcgtgaagaccggcgtgcccaccgccagccccgccagcagcgccgacatggcccccatcagcagcggcagcagcacctggaccagcagcggcatccccttcagcttcgtgagcatggccaccggcatgggccccagcagcagcggcagccaggccaccgtggccagcgtggtgaccagcaccctgctggccggcctgggcttcggcggcggcggcatcagcagcttccccagcaccgtgtggcccaccagactgcccaccgccgccagcgccagcaagcaggccgccagacccgtgctggccaccaccgaggccctggccagccccggccccgacggcgacagcagccccaccaaggacggcgagggcaccgaggagggcgagaaggacgagaagagcgagagcgaggacggcgagagagagcacgaggaggacggcgagaaggacagcgagaagaaggagaagagcggcgtgacccacgccgccgaggagagaaaccagaccgagcccagccccacccccagcagccccaacagaaccgccgagggcggccaccagaccatccccggccacgagcaggaccacaccgccgtgcccaccgaccagaccggcggcagaagagacgccggccccggcctggaccccgacatggtgaccagcacccaggtgccccccaccgccaccgaggagcagtacgccggcagcgaccccaagagacccgagatgcccagcaagaagcccatgagcagaggcgacagattcagcgaggacagcagattcatcaccgtgaaccccgccgagaagaacaccagcggcatgatcagcagacccgcccccggcagaatggagtggatcatccccctgatcgtggtgagcgccctgaccttcgtgtgcctgatcctgctgatcgccgtgctggtgtactggagaggctgcaacaagatcaagagcaagggcttccccagaagattcagagaggtgcccagcagcggcgagagaggcgagaagggcagcagaaagtgcttccagaccgcccacttctacgtggaggacagcagcagccccagagtggtgcccaacgagagcatccccatcatccccatccccgacgacatggaggccatccccgtgaagcagttcgtgaagcacatcggcgagctgtacagcaacaaccagcacggcttcagcgaggacttcgaggaggtgcagagatgcaccgccgacatgaacatcaccgccgagcacagcaaccaccccgagaacaagcacaagaacagatacatcaacatcctggcctacgaccacagcagagtgaagctgagacccctgcccggcaaggacagcaagcacagcgactacatcaacgccaactacgtggacggctacaacaaggccaaggcctacatcgccacccagggccccctgaagagcaccttcgaggacttctggagaatgatctgggagcagaacaccggcatcatcgtgatgatcaccaacctggtggagaagggcagaagaaagtgcgaccagtactggcccaccgagaacagcgaggagtacggcaacatcatcgtgaccctgaagagcaccaagatccacgcctgctacaccgtgagaagattcagcatcagaaacaccaaggtgaagaagggccagaagggcaaccccaagggcagacagaacgagagagtggtgatccagtaccactacacccagtggcccgacatgggcgtgcccgagtacgccctgcccgtgctgaccttcgtgagaagaagcagcgccgccagaatgcccgagaccggccccgtgctggtgcactgcagcgccggcgtgggcagaaccggcacctacatcgtgatcgacagcatgctgcagcagatcaaggacaagagcaccgtgaacgtgctgggcttcctgaagcacatcagaacccagagaaactacctggtgcagaccgaggagcagtacatcttcatccacgacgccctgctggaggccatcctgggcaaggagaccgaggtgagcagcaaccagctgcacagctacgtgaacagcatcctgatccccggcgtgggcggcaagaccagactggagaagcagttcaagctggtgacccagtgcaacgccaagtacgtggagtgcttcagcgcccagaaggagtgcaacaaggagaagaacagaaacagcagcgtggtgcccagcgagagagccagagtgggcctggcccccctgcccggcatgaagggcaccgactacatcaacgccagctacatcatgggctactacagaagcaacgagttcatcatcacccagcaccccctgccccacaccaccaaggacttctggagaatgatctgggaccacaacgcccagatcatcgtgatgctgcccgacaaccagagcctggccgaggacgagttcgtgtactggcccagcagagaggagagcatgaactgcgaggccttcaccgtgaccctgatcagcaaggacagactgtgcctgagcaacgaggagcagatcatcatccacgacttcatcctggaggccacccaggacgactacgtgctggaggtgagacacttccagtgccccaagtggcccaaccccgacgcccccatcagcagcaccttcgagctgatcaacgtgatcaaggaggaggccctgaccagagacggccccaccatcgtgcacgacgagtacggcgccgtgagcgccggcatgctgtgcgccctgaccaccctgagccagcagctggagaacgagaacgccgtggacgtgttccaggtggccaagatgatcaacctgatgagacccggcgtgttcaccgacatcgagcagtaccagttcatctacaaggccatgctgagcctggtgagcaccaaggagaacggcaacggccccatgaccgtggacaagaacggcgccgtgctgatcgccgacgagagcgaccccgccgagagcatggagagcctggtgtag

SEQ ID NO: 95548 - DNA, 309 bp, Artificial Sequence
  Description of Artificial Sequence: Synthetic coding sequence
atgagaagactgctggagccctgctggtggatcctgttcctgaagatcaccagcagcgtgctgcactacgtggtgtgcttccccgccctgaccgagggctacgtgggcgccctgcacgagaacagacacggcagcgccgtgcagatcagaagaagaaaggccagcggcgacccctactgggcctacagcggcaagagcagctgcagcaacggcgaccacaccggccagctgaccagccacagcacccacctgaaggcccacttcgagagcctgctgtgcctgagcagcgtgtgcagcaacctgagctag

SEQ ID NO: 95549 - DNA, 2814 bp, Artificial Sequence
  Description of Artificial Sequence: Synthetic coding sequence
atggccggcgccggcggcggcctgggcgtgtggggcaacctggtgctgctgggcctgtgcagctggaccggcgccagagcccccgcccccaaccccggcagaaacctgaccgtggagacccagaccaccagcagcatcagcctgagctgggaggtgcccgacggcctggacagccagaacagcaactactgggtgcagtgcaccggcgacggcggcaccaccgagaccagaaacaccaccgccaccaacgtgaccgtggacggcctgggccccggcagcctgtacacctgcagcgtgtgggtggagaaggacggcgtgaacagcagcgtgggcaccgtgaccaccgccaccgcccccaaccccgtgagaaacctgaccgtggaggcccagaccaacagcagcatcgccctgacctgggaggtgcccgacggccccgacccccagaacagcacctacggcgtggagtacaccggcgacggcggcagagccggcaccagaagcaccgcccacaccaacatcaccgtggacagactggagcccggctgcctgtacgtgttcagcgtgtgggtgggcaagaacggcatcaacagcagcagagagaccagaaacgccaccaccgcccccaaccccgtgagaaacctgcacatggagacccagaccaacagcagcatcgccctgtgctgggaggtgcccgacggcccctacccccaggactacacctactgggtggagtacaccggcgacggcggcggcaccgagaccagaaacaccaccaacaccagcgtgaccgccgagagactggagcccggcaccctgtacaccttcagcgtgtgggccgagaagaacggcgccagaggcagcagacagaacgtgagcatcagcaccgtgcccaacgccgtgaccagcctgagcaagcaggactggaccaacagcaccatcgccctgagatggaccgccccccagggccccggccagagcagctacagctactgggtgagctgggtgagagagggcatgaccgaccccagaacccagagcaccagcggcaccgacatcaccctgaaggagctggaggccggcagcctgtaccacctgaccgtgtgggccgagagaaacgaggtgagaggctacaacagcaccctgaccgccgccaccgcccccaacgaggtgaccgacctgcagaacgagacccagaccaagaacagcgtgatgctgtggtggaaggcccccggcgacccccacagccagctgtacgtgtactgggtgcagtgggccagcaagggccaccccagaagaggccaggacccccaggccaactgggtgaaccagaccagcagaaccaacgagacctggtacaaggtggaggccctggagcccggcaccctgtacaacttcaccgtgtgggccgagagaaacgacgtggccagcagcacccagagcctgtgcgccagcacctaccccgacaccgtgaccatcaccagctgcgtgagcaccagcgccggctacggcgtgaacctgatctggagctgcccccagggcggctacgaggccttcgagctggaggtgggcggccagagaggcagccaggacagaagcagctgcggcgaggccgtgagcgtgctgggcctgggccccgccagaagctaccccgccaccatcaccaccatctgggacggcatgaaggtggtgagccacagcgtggtgtgccacaccgagagcgccggcgtgatcgccggcgccttcgtgggcatcctgctgttcctgatcctggtgggcctgctgatcttcttcctgaagagaagaaacaagaagaagcagcagaagcccgagctgagagacctggtgttcagcagccccggcgacatccccgccgaggacttcgccgaccacgtgagaaagaacgagagagacagcaactgcggcttcgccgacaagtaccagcagctgagcctggtgggccacagccagagccagatggtggccagcgccagcgagaacaacgccaagaacagatacagaaacgtgctgccctacgactggagcagagtgcccctgaagcccatccacgaggagcccggcagcgactacatcaacgccagcttcatgcccggcctgtggagcccccaggagttcatcgccacccagggccccctgccccagaccgtgggcgacttctggagactggtgtgggagcagcagagccacaccctggtgatgctgaccaactgcatggaggccggcagagtgaagtgcgagcactactggcccctggacagccagccctgcacccacggccacctgagagtgaccctggtgggcgaggaggtgatggagaactggaccgtgagagagctgctgctgctgcaggtggaggagcagaagaccctgagcgtgagacagttccactaccaggcctggcccgaccacggcgtgcccagcagccccgacaccctgctggccttctggagaatgctgagacagtggctggaccagaccatggagggcggcccccccatcgtgcactgcagcgccggcgtgggcagaaccggcaccctgatcgccctggacgtgctgctgagacagctgcagagcgagggcctgctgggccccttcagcttcgtgagaaagatgagagagagcagacccctgatggtgcagaccgaggcccagtacgtgttcctgcaccagtgcatcctgagattcctgcagcagagcgcccaggcccccgccgagaaggaggtgccctacgaggacgtggagaacctgatctacgagaacgtggccgccatccaggcccacaagctggaggtgtag

SEQ ID NO: 95550 - DNA, 3348 bp, Artificial Sequence
  Description of Artificial Sequence: Synthetic coding sequence
atggccggcgccggcggcggcctgggcgtgtggggcaacctggtgctgctgggcctgtgcagctggaccggcgccagagcccccgcccccaaccccggcagaaacctgaccgtggagacccagaccaccagcagcatcagcctgagctgggaggtgcccgacggcctggacagccagaacagcaactactgggtgcagtgcaccggcgacggcggcaccaccgagaccagaaacaccaccgccaccaacgtgaccgtggacggcctgggccccggcagcctgtacacctgcagcgtgtgggtggagaaggacggcgtgaacagcagcgtgggcaccgtgaccaccgccaccgcccccaaccccgtgagaaacctgagagtggaggcccagaccaacagcagcatcgccctgacctgggaggtgcccgacggccccgacccccagaacagcacctacggcgtggagtacaccggcgacggcggcagagccggcaccagaagcaccgcccacaccaacatcaccgtggacggcctggagcccggctgcctgtacgccttcagcatgtgggtgggcaagaacggcatcaacagcagcagagagaccagaaacgccaccaccgcccacaaccccgtgagaaacctgagagtggaggcccagaccaccagcagcatcagcctgagctgggaggtgcccgacggcaccgacccccagaacagcacctactgcgtgcagtgcaccggcgacggcggcagaaccgagaccagaaacaccaccgacaccagagtgaccgtggacggcctgggccccggcagcctgtacacctgcagcgtgtgggtggagaaggacggcgtgaacagcagcgtggagatcgtgaccagcgccaccgcccccaaccccgtgagaaacctgaccgtggaggcccagaccaacagcagcatcgccctgacctgggaggtgcccgacggccccgacccccagaacagcacctacggcgtggagtacaccggcgacggcggcagagccggcaccagaagcaccgcccacaccaacatcaccgtggacagactggagcccggctgcctgtacgtgttcagcgtgtgggtgggcaagaacggcatcaacagcagcagagagaccagaaacgccaccaccgcccccaaccccgtgagaaacctgcacatggagacccagaccaacagcagcatcgccctgtgctgggaggtgcccgacggcccctacccccaggactacacctactgggtggagtacaccggcgacggcggcggcaccgagaccagaaacaccaccaacaccagcgtgaccgccgagagactggagcccggcaccctgtacaccttcagcgtgtgggccgagaagaacggcgccagaggcagcagacagaacgtgagcatcagcaccgtgcccaacgccgtgaccagcctgagcaagcaggactggaccaacagcaccatcgccctgagatggaccgccccccagggccccggccagagcagctacagctactgggtgagctgggtgagagagggcatgaccgaccccagaacccagagcaccagcggcaccgacatcaccctgaaggagctggaggccggcagcctgtaccacctgaccgtgtgggccgagagaaacgaggtgagaggctacaacagcaccctgaccgccgccaccgcccccaacgaggtgaccgacctgcagaacgagacccagaccaagaacagcgtgatgctgtggtggaaggcccccggcgacccccacagccagctgtacgtgtactgggtgcagtgggccagcaagggccaccccagaagaggccaggacccccaggccaactgggtgaaccagaccagcagaaccaacgagacctggtacaaggtggaggccctggagcccggcaccctgtacaacttcaccgtgtgggccgagagaaacgacgtggccagcagcacccagagcctgtgcgccagcacctaccccgacaccgtgaccatcaccagctgcgtgagcaccagcgccggctacggcgtgaacctgatctggagctgcccccagggcggctacgaggccttcgagctggaggtgggcggccagagaggcagccaggacagaagcagctgcggcgaggccgtgagcgtgctgggcctgggccccgccagaagctaccccgccaccatcaccaccatctgggacggcatgaaggtggtgagccacagcgtggtgtgccacaccgagagcgccggcgtgatcgccggcgccttcgtgggcatcctgctgttcctgatcctggtgggcctgctgatcttcttcctgaagagaagaaacaagaagaagcagcagaagcccgagctgagagacctggtgttcagcagccccggcgacatccccgccgaggacttcgccgaccacgtgagaaagaacgagagagacagcaactgcggcttcgccgacaagtaccagcagctgagcctggtgggccacagccagagccagatggtggccagcgccagcgagaacaacgccaagaacagatacagaaacgtgctgccctacgactggagcagagtgcccctgaagcccatccacgaggagcccggcagcgactacatcaacgccagcttcatgcccggcctgtggagcccccaggagttcatcgccacccagggccccctgccccagaccgtgggcgacttctggagactggtgtgggagcagcagagccacaccctggtgatgctgaccaactgcatggaggccggcagagtgaagtgcgagcactactggcccctggacagccagccctgcacccacggccacctgagagtgaccctggtgggcgaggaggtgatggagaactggaccgtgagagagctgctgctgctgcaggtggaggagcagaagaccctgagcgtgagacagttccactaccaggcctggcccgaccacggcgtgcccagcagccccgacaccctgctggccttctggagaatgctgagacagtggctggaccagaccatggagggcggcccccccatcgtgcactgcagcgccggcgtgggcagaaccggcaccctgatcgccctggacgtgctgctgagacagctgcagagcgagggcctgctgggccccttcagcttcgtgagaaagatgagagagagcagacccctgatggtgcagaccgaggcccagtacgtgttcctgcaccagtgcatcctgagattcctgcagcagagcgcccaggcccccgccgagaaggaggtgccctacgaggacgtggagaacctgatctacgagaacgtggccgccatccaggcccacaagctggaggtgtag

SEQ ID NO: 95551 - DNA, 1278 bp, Artificial Sequence
  Description of Artificial Sequence: Synthetic coding sequence
atgaagcccgccgccagagaggccagactgccccccagaagccccggcctgagatgggccctgcccctgctgctgctgctgctgagactgggccagatcctgtgcgccggcggcacccccagccccatccccgaccccagcgtggccaccgtggccaccggcgagaacggcatcacccagatcagcagcaccgccgagagcttccacaagcagaacggcaccggcaccccccaggtggagaccaacaccagcgaggacggcgagagcagcggcgccaacgacagcctgagaacccccgagcagggcagcaacggcaccgacggcgccagccagaagacccccagcagcaccggccccagccccgtgttcgacatcaaggccgtgagcatcagccccaccaacgtgatcctgacctggaagagcaacgacaccgccgccagcgagtacaagtacgtggtgaagcacaagatggagaacgagaagaccatcaccgtggtgcaccagccctggtgcaacatcaccggcctgagacccgccaccagctacgtgttcagcatcacccccggcatcggcaacgagacctggggcgaccccagagtgatcaaggtgatcaccgagcccatccccgtgagcgacctgagagtggccctgaccggcgtgagaaaggccgccctgagctggagcaacggcaacggcaccgccagctgcagagtgctgctggagagcatcggcagccacgaggagctgacccaggacagcagactgcaggtgaacatcagcggcctgaagcccggcgtgcagtacaacatcaacccctacctgctgcagagcaacaagaccaagggcgaccccctgggcaccgagggcggcctggacgccagcaacaccgagagaagcagagccggcagccccaccgcccccgtgcacgacgagagcctggtgggccccgtggaccccagcagcggccagcagagcagagacaccgaggtgctgctggtgggcctggagcccggcaccagatacaacgccaccgtgtacagccaggccgccaacggcaccgagggccagccccaggccatcgagttcagaaccaacgccatccaggtgttcgacgtgaccgccgtgaacatcagcgccaccagcctgaccctgatctggaaggtgagcgacaacgagagcagcagcaactacacctacaagatccacgtggccggcgagaccgacagcagcaacctgaacgtgagcgagcccagagccgtgatccccggcctgagatag

SEQ ID NO: 95552 - DNA, 4014 bp, Artificial Sequence
  Description of Artificial Sequence: Synthetic coding sequence
atgaagcccgccgccagagaggccagactgccccccagaagccccggcctgagatgggccctgcccctgctgctgctgctgctgagactgggccagatcctgtgcgccggcggcacccccagccccatccccgaccccagcgtggccaccgtggccaccggcgagaacggcatcacccagatcagcagcaccgccgagagcttccacaagcagaacggcaccggcaccccccaggtggagaccaacaccagcgaggacggcgagagcagcggcgccaacgacagcctgagaacccccgagcagggcagcaacggcaccgacggcgccagccagaagacccccagcagcaccggccccagccccgtgttcgacatcaaggccgtgagcatcagccccaccaacgtgatcctgacctggaagagcaacgacaccgccgccagcgagtacaagtacgtggtgaagcacaagatggagaacgagaagaccatcaccgtggtgcaccagccctggtgcaacatcaccggcctgagacccgccaccagctacgtgttcagcatcacccccggcatcggcaacgagacctggggcgaccccagagtgatcaaggtgatcaccgagcccatccccgtgagcgacctgagagtggccctgaccggcgtgagaaaggccgccctgagctggagcaacggcaacggcaccgccagctgcagagtgctgctggagagcatcggcagccacgaggagctgacccaggacagcagactgcaggtgaacatcagcggcctgaagcccggcgtgcagtacaacatcaacccctacctgctgcagagcaacaagaccaagggcgaccccctgggcaccgagggcggcctggacgccagcaacaccgagagaagcagagccggcagccccaccgcccccgtgcacgacgagagcctggtgggccccgtggaccccagcagcggccagcagagcagagacaccgaggtgctgctggtgggcctggagcccggcaccagatacaacgccaccgtgtacagccaggccgccaacggcaccgagggccagccccaggccatcgagttcagaaccaacgccatccaggtgttcgacgtgaccgccgtgaacatcagcgccaccagcctgaccctgatctggaaggtgagcgacaacgagagcagcagcaactacacctacaagatccacgtggccggcgagaccgacagcagcaacctgaacgtgagcgagcccagagccgtgatccccggcctgagaagcagcaccttctacaacatcaccgtgtgccccgtgctgggcgacatcgagggcacccccggcttcctgcaggtgcacaccccccccgtgcccgtgagcgacttcagagtgaccgtggtgagcaccaccgagatcggcctggcctggagcagccacgacgccgagagcttccagatgcacatcacccaggagggcgccggcaacagcagagtggagatcaccaccaaccagagcatcatcatcggcggcctgttccccggcaccaagtactgcttcgagatcgtgcccaagggccccaacggcaccgagggcgccagcagaaccgtgtgcaacagaaccgtgcccagcgccgtgttcgacatccacgtggtgtacgtgaccaccaccgagatgtggctggactggaagagccccgacggcgccagcgagtacgtgtaccacctggtgatcgagagcaagcacggcagcaaccacaccagcacctacgacaaggccatcaccctgcagggcctgatccccggcaccctgtacaacatcaccatcagccccgaggtggaccacgtgtggggcgaccccaacagcaccgcccagtacaccagacccagcaacgtgagcaacatcgacgtgagcaccaacaccaccgccgccaccctgagctggcagaacttcgacgacgccagccccacctacagctactgcctgctgatcgagaaggccggcaacagcagcaacgccacccaggtggtgaccgacatcggcatcaccgacgccaccgtgaccgagctgatccccggcagcagctacaccgtggagatcttcgcccaggtgggcgacggcatcaagagcctggagcccggcagaaagagcttctgcaccgaccccgccagcatggccagcttcgactgcgaggtggtgcccaaggagcccgccctggtgctgaagtggacctgcccccccggcgccaacgccggcttcgagctggaggtgagcagcggcgcctggaacaacgccacccacctggagagctgcagcagcgagaacggcaccgagtacagaaccgaggtgacctacctgaacttcagcaccagctacaacatcagcatcaccaccgtgagctgcggcaagatggccgcccccaccagaaacacctgcaccaccggcatcaccgacccccccccccccgacggcagccccaacatcaccagcgtgagccacaacagcgtgaaggtgaagttcagcggcttcgaggccagccacggccccatcaaggcctacgccgtgatcctgaccaccggcgaggccggccaccccagcgccgacgtgctgaagtacacctacgaggacttcaagaagggcgccagcgacacctacgtgacctacctgatcagaaccgaggagaagggcagaagccagagcctgagcgaggtgctgaagtacgagatcgacgtgggcaacgagagcaccaccctgggctactacaacggcaagctggagcccctgggcagctacagagcctgcgtggccggcttcaccaacatcaccttccacccccagaacaagggcctgatcgacggcgccgagagctacgtgagcttcagcagatacagcgacgccgtgagcctgccccaggaccccggcgtgatctgcggcgccgtgttcggctgcatcttcggcgccctggtgatcgtgaccgtgggcggcttcatcttctggagaaagaagagaaaggacgccaagaacaacgaggtgagcttcagccagatcaagcccaagaagagcaagctgatcagagtggagaacttcgaggcctacttcaagaagcagcaggccgacagcaactgcggcttcgccgaggagtacgaggacctgaagctggtgggcatcagccagcccaagtacgccgccgagctggccgagaacagaggcaagaacagatacaacaacgtgctgccctacgacatcagcagagtgaagctgagcgtgcagacccacagcaccgacgactacatcaacgccaactacatgcccggctaccacagcaagaaggacttcatcgccacccagggccccctgcccaacaccctgaaggacttctggagaatggtgtgggagaagaacgtgtacgccatcatcatgctgaccaagtgcgtggagcagggcagaaccaagtgcgaggagtactggcccagcaagcaggcccaggactacggcgacatcaccgtggccatgaccagcgagatcgtgctgcccgagtggaccatcagagacttcaccgtgaagaacatccagaccagcgagagccaccccctgagacagttccacttcaccagctggcccgaccacggcgtgcccgacaccaccgacctgctgatcaacttcagatacctggtgagagactacatgaagcagagcccccccgagagccccatcctggtgcactgcagcgccggcgtgggcagaaccggcaccttcatcgccatcgacagactgatctaccagatcgagaacgagaacaccgtggacgtgtacggcatcgtgtacgacctgagaatgcacagacccctgatggtgcagaccgaggaccagtacgtgttcctgaaccagtgcgtgctggacatcgtgagaagccagaaggacagcaaggtggacctgatctaccagaacaccaccgccatgaccatctacgagaacctggcccccgtgaccaccttcggcaagaccaacggctacatcgcctag

SEQ ID NO: 95553 - DNA, 1620 bp, Artificial Sequence
  Description of Artificial Sequence: Synthetic coding sequence
atgaagcccgccgccagagaggccagactgccccccagaagccccggcctgagatgggccctgcccctgctgctgctgctgctgagactgggccagatcctgtgcgccggcggcacccccagccccatccccgaccccagcgtggccaccgtggccaccggcgagaacggcatcacccagatcagcagcaccgccgagagcttccacaagcagaacggcaccggcaccccccaggtggagaccaacaccagcgaggacggcgagagcagcggcgccaacgacagcctgagaacccccgagcagggcagcaacggcaccgacggcgccagccagaagacccccagcagcaccggccccagccccgtgttcgacatcaaggccgtgagcatcagccccaccaacgtgatcctgacctggaagagcaacgacaccgccgccagcgagtacaagtacgtggtgaagcacaagatggagaacgagaagaccatcaccgtggtgcaccagccctggtgcaacatcaccggcctgagacccgccaccagctacgtgttcagcatcacccccggcatcggcaacgagacctggggcgaccccagagtgatcaaggtgatcaccgagcccatccccgtgagcgacctgagagtggccctgaccggcgtgagaaaggccgccctgagctggagcaacggcaacggcaccgccagctgcagagtgctgctggagagcatcggcagccacgaggagctgacccaggacagcagactgcaggtgaacatcagcggcctgaagcccggcgtgcagtacaacatcaacccctacctgctgcagagcaacaagaccaagggcgaccccctgggcaccgagggcggcctggacgccagcaacaccgagagaagcagagccggcagccccaccgcccccgtgcacgacgagagcctggtgggccccgtggaccccagcagcggccagcagagcagagacaccgaggtgctgctggtgggcctggagcccggcaccagatacaacgccaccgtgtacagccaggccgccaacggcaccgagggccagccccaggccatcgagttcagaaccaacgccatccaggtgttcgacgtgaccgccgtgaacatcagcgccaccagcctgaccctgatctggaaggtgagcgacaacgagagcagcagcaactacacctacaagatccacgtggccggcgagaccgacagcagcaacctgaacgtgagcgagcccagagccgtgatccccggcctgagaagcagcaccttctacaacatcaccgtgtgccccgtgctgggcgacatcgagggcacccccggcttcctgcaggtgcacaccccccccgtgcccgtgagcgacttcagagtgaccgtggtgagcaccaccgagatcggcctggcctggagcagccacgacgccgagagcttccagatgcacatcacccaggagggcgccggcaacagcagagtggagatcaccaccaaccagagcatcatcatcggcggcctgttccccggcaccaagtactgcttcgagatcgtgcccaagggccccaacggcaccgagggcgccagcagaaccgtgtgcaacagaaccggctag

SEQ ID NO: 95554 - DNA, 4419 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagaagaagctactacagctacagctactacctgaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagactgcccaacgaccccctggtgcccaccgccgtgctggtgcccatcaccgacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacatctggctgtacagagacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95555 - DNA, 4377 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagactgcccaacgaccccctggtgcccaccgccgtgctggacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacatctggctgtacagagacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95556 - DNA, 4341 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagatacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacatctggctgtacagagacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95557 - DNA, 4320 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagatacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95558 - DNA, 4323 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagatacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95559 - DNA, 4374 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagactgcccaacgaccccctggtgcccaccgccgtgctggacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacgtgagcatcttcatcggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95560 - DNA, 2244 bp, Artificial Sequence
  Description of Artificial Sequence: Synthetic coding sequence
atgaccctgaacggctgcatgctggtgctgaagagcctgatcatctaccaccccagatgccccaaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagatacatctgctggagaagacacatctgcatcagaaacatcagaagaagctactacagctacagctactacctgaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagactgcccaacgaccccctggtgcccaccgccgtgctggtgcccagccccggcagaaagaacgtgtaccacggcgacaacaacagcttcttcgccatcagctacctgtag

SEQ ID NO: 95561 - DNA, 4389 bp, Artificial Sequence
  Description of Artificial Sequence: Synthetic coding sequence
atggacaccaccgccgccgccgccctgcccgccttcgtggccctgctgctgctgagcccctggcccctgctgggcagcgcccagggccagttcagcgccggcggctgcaccttcgacgacggccccggcgcctgcgactaccaccaggacctgtacgacgacttcgagtgggtgcacgtgagcgcccaggagccccactacctgccccccgagatgccccagggcagctacatgatcgtggacagcagcgaccacgaccccggcgagaaggccagactgcagctgcccaccatgaaggagaacgacacccactgcatcgacttcagctacctgctgtacagccagaagggcctgaaccccggcaccctgaacatcctggtgagagtgaacaagggccccctggccaaccccatctggaacgtgaccggcttcaccggcagagactggctgagagccgagctggccgtgagcaccttctggcccaacgagtaccaggtgatcttcgaggccgaggtgagcggcggcagaagcggctacatcgccatcgacgacatccaggtgctgagctacccctgcgacaagagcccccacttcctgagactgggcgacgtggaggtgaacgccggccagaacgccaccttccagtgcatcgccaccggcagagacgccgtgcacaacaagctgtggctgcagagaagaaacggcgaggacatccccgtggcccagaccaagaacatcaaccacagaagattcgccgccagcttcagactgcaggaggtgaccaagaccgaccaggacctgtacagatgcgtgacccagagcgagagaggcagcggcgtgagcaacttcgcccagctgatcgtgagagagccccccagacccatcgcccccccccagctgctgggcgtgggccccacctacctgctgatccagctgaacgccaacagcatcatcggcgacggccccatcatcctgaaggaggtggagtacagaatgaccagcggcagctggaccgagacccacgccgtgaacgcccccacctacaagctgtggcacctggaccccgacaccgagtacgagatcagagtgctgctgaccagacccggcgagggcggcaccggcctgcccggcccccccctgatcaccagaaccaagtgcgccgagcccatgagaacccccaagaccctgaagatcgccgagatccaggccagaagaatcgccgtggactgggagagcctgggctacaacatcaccagatgccacaccttcaacgtgaccatctgctaccactacttcagaggccacaacgagagcaaggccgactgcctggacatggaccccaaggccccccagcacgtggtgaaccacctgcccccctacaccaacgtgagcctgaagatgatcctgaccaaccccgagggcagaaaggagagcgaggagaccatcatccagaccgacgaggacgtgcccggccccgtgcccgtgaagagcctgcagggcaccagcttcgagaacaagatcttcctgaactggaaggagcccctggaccccaacggcatcatcacccagtacgagatcagctacagcagcatcagaagcttcgaccccgccgtgcccgtggccggccccccccagaccgtgagcaacctgtggaacagcacccaccacgtgttcatgcacctgcaccccggcaccacctaccagttcttcatcagagccagcaccgtgaagggcttcggccccgccaccgccatcaacgtgaccaccaacatcagcgcccccaccctgcccgactacgagggcgtggacgccagcctgaacgagaccgccaccaccatcaccgtgctgctgagacccgcccaggccaagggcgcccccatcagcgcctaccagatcgtggtggaggagctgcacccccacagaaccaagagagaggccggcgccatggagtgctaccaggtgcccgtgacctaccagaacgccatgagcggcggcgccccctactacttcgccgccgagctgccccccggcaacctgcccgagcccgcccccttcaccgtgggcgacaacagaacctaccagggcttctggaacccccccctggcccccagaaagggctacaacatctacttccaggccatgagcagcgtggagaaggagaccaagacccagtgcgtgagaatcgccaccaaggccgccgccaccgaggagcccgaggtgatccccgaccccgccaagcagaccgacagagtggtgaagatcgccggcatcagcgccggcatcctggtgttcatcctgctgctgctggtggtgatcctgatcgtgaagaagagcaagctggccaagaagagaaaggacgccatgggcaacaccagacaggagatgacccacatggtgaacgccatggacagaagctacgccgaccagagcaccctgcacgccgaggaccccctgagcatcaccttcatggaccagcacaacttcagccccagactgcccaacgaccccctggtgcccaccgccgtgctggtgcccatcaccgacgagaaccacagcgccaccgccgagagcagcagactgctggacgtgcccagatacctgtgcgagggcaccgagagcccctaccagaccggccagctgcaccccgccatcagagtggccgacctgctgcagcacatcaacctgatgaagaccagcgacagctacggcttcaaggaggagtacgagagcttcttcgagggccagagcgccagctgggacgtggccaagaaggaccagaacagagccaagaacagatacggcaacatcatcgcctacgaccacagcagagtgatcctgcagcccgtggaggacgaccccagcagcgactacatcaacgccaactacatcgacatctggctgtacagagacggctaccagagacccagccactacatcgccacccagggccccgtgcacgagaccgtgtacgacttctggagaatgatctggcaggagcagagcgcctgcatcgtgatggtgaccaacctggtggaggtgggcagagtgaagtgctacaagtactggcccgacgacaccgaggtgtacggcgacttcaaggtgacctgcgtggagatggagcccctggccgagtacgtggtgagaaccttcaccctggagagaagaggctacaacgagatcagagaggtgaagcagttccacttcaccggctggcccgaccacggcgtgccctaccacgccaccggcctgctgagcttcatcagaagagtgaagctgagcaacccccccagcgccggccccatcgtggtgcactgcagcgccggcgccggcagaaccggctgctacatcgtgatcgacatcatgctggacatggccgagagagagggcgtggtggacatctacaactgcgtgaaggccctgagaagcagaagaatcaacatggtgcagaccgaggagcagtacatcttcatccacgacgccatcctggaggcctgcctgtgcggcgagaccgccatccccgtgtgcgagttcaaggccgcctacttcgacatgatcagaatcgacagccagaccaacagcagccacctgaaggacgagttccagaccctgaacagcgtgacccccagactgcaggccgaggactgcagcatcgcctgcctgcccagaaaccacgacaagaacagattcatggacatgctgccccccgacagatgcctgcccttcctgatcaccatcgacggcgagagcagcaactacatcaacgccgccctgatggacagctacagacagcccgccgccttcatcgtgacccagtaccccctgcccaacaccgtgaaggacttctggagactggtgtacgactacggctgcaccagcatcgtgatgctgaacgaggtggacctgagccagggctgcccccagtactggcccgaggagggcatgctgagatacggccccatccaggtggagtgcatgagctgcagcatggactgcgacgtgatcaacagaatcttcagaatctgcaacctgaccagaccccaggagggctacctgatggtgcagcagttccagtacctgggctgggccagccacagagaggtgcccggcagcaagagaagcttcctgaagctgatcctgcaggtggagaagtggcaggaggagtgcgaggagggcgagggcagaaccatcatccactgcctgaacggcggcggcagaagcggcatgttctgcgccatcggcatcgtggtggagatggtgaagagacagaacgtggtggacgtgttccacgccgtgaagaccctgagaaacagcaagcccaacatggtggaggcccccgagcagtacagattctgctacgacgtggccctggagtacctggagagcagctag

SEQ ID NO: 95562 - DNA, 4359 bp, Artificial Sequence
  Description of Artificial Sequence: Synthetic coding sequence
atgagaggcctgggcacctgcctggccaccctggccggcctgctgctgaccgccgccggcgagaccttcagcggcggctgcctgttcgacgagccctacagcacctgcggctacagccagagcgagggcgacgacttcaactgggagcaggtgaacaccctgaccaagcccaccagcgacccctggatgcccagcggcagcttcatgctggtgaacgccagcggcagacccgagggccagagagcccacctgctgctgccccagctgaaggagaacgacacccactgcatcgacttccactacttcgtgagcagcaagagcaacagcccccccggcctgctgaacgtgtacgtgaaggtgaacaacggccccctgggcaaccccatctggaacatcagcggcgaccccaccagaacctggaacagagccgagctggccatcagcaccttctggcccaacttctaccaggtgatcttcgaggtgatcaccagcggccaccagggctacctggccatcgacgaggtgaaggtgctgggccacccctgcaccagaaccccccacttcctgagaatccagaacgtggaggtgaacgccggccagttcgccaccttccagtgcagcgccatcggcagaaccgtggccggcgacagactgtggctgcagggcatcgacgtgagagacgcccccctgaaggagatcaaggtgaccagcagcagaagattcatcgccagcttcaacgtggtgaacaccaccaagagagacgccggcaagtacagatgcatgatcagaaccgagggcggcgtgggcatcagcaactacgccgagctggtggtgaaggagccccccgtgcccatcgcccccccccagctggccagcgtgggcgccacctacctgtggatccagctgaacgccaacagcatcaacggcgacggccccatcgtggccagagaggtggagtactgcaccgccagcggcagctggaacgacagacagcccgtggacagcaccagctacaagatcggccacctggaccccgacaccgagtacgagatcagcgtgctgctgaccagacccggcgagggcggcaccggcagccccggccccgccctgagaaccagaaccaagtgcgccgaccccatgagaggccccagaaagctggaggtggtggaggtgaagagcagacagatcaccatcagatgggagcccttcggctacaacgtgaccagatgccacagctacaacctgaccgtgcactactgctaccaggtgggcggccaggagcaggtgagagaggaggtgagctgggacaccgagaacagccacccccagcacaccatcaccaacctgagcccctacaccaacgtgagcgtgaagctgatcctgatgaaccccgagggcagaaaggagagccaggagctgatcgtgcagaccgacgaggacctgcccggcgccgtgcccaccgagagcatccagggcagcaccttcgaggagaagatcttcctgcagtggagagagcccacccagacctacggcgtgatcaccctgtacgagatcacctacaaggccgtgagcagcttcgaccccgagatcgacctgagcaaccagagcggcagagtgagcaagctgggcaacgagacccacttcctgttcttcggcctgtaccccggcaccacctacagcttcaccatcagagccagcaccgccaagggcttcggcccccccgccaccaaccagttcaccaccaagatcagcgcccccagcatgcccgcctacgagctggagacccccctgaaccagaccgacaacaccgtgaccgtgatgctgaagcccgcccacagcagaggcgcccccgtgagcgtgtaccagatcgtggtggaggaggagagacccagaagaaccaagaagaccaccgagatcctgaagtgctaccccgtgcccatccacttccagaacgccagcctgctgaacagccagtactacttcgccgccgagttccccgccgacagcctgcaggccgcccagcccttcaccatcggcgacaacaagacctacaacggctactggaacacccccctgctgccctacaagagctacagaatctacttccaggccgccagcagagccaacggcgagaccaagatcgactgcgtgcaggtggccaccaagggcgccgccacccccaagcccgtgcccgagcccgagaagcagaccgaccacaccgtgaagatcgccggcgtgatcgccggcatcctgctgttcgtgatcatcttcctgggcgtggtgctggtgatgaagaagagaaagctggccaagaagagaaaggagaccatgagcagcaccagacaggagatgaccgtgatggtgaacagcatggacaagagctacgccgagcagggcaccaactgcgacgaggccttcagcttcatggacacccacaacctgaacggcagaagcgtgagcagccccagcagcttcaccatgaagaccaacaccctgagcaccagcgtgcccaacagctactaccccgacgagacccacaccatggccagcgacaccagcagcctggtgcagagccacacctacaagaagagagagcccgccgacgtgccctaccagaccggccagctgcaccccgccatcagagtggccgacctgctgcagcacatcacccagatgaagtgcgccgagggctacggcttcaaggaggagtacgagagcttcttcgagggccagagcgccccctgggacagcgccaagaaggacgagaacagaatgaagaacagatacggcaacatcatcgcctacgaccacagcagagtgagactgcagaccatcgagggcgacaccaacagcgactacatcaacggcaactacatcgacggctaccacagacccaaccactacatcgccacccagggccccatgcaggagaccatctacgacttctggagaatggtgtggcacgagaacaccgccagcatcatcatggtgaccaacctggtggaggtgggcagagtgaagtgctgcaagtactggcccgacgacaccgagatctacaaggacatcaaggtgaccctgatcgagaccgagctgctggccgagtacgtgatcagaaccttcgccgtggagaagagaggcgtgcacgagatcagagagatcagacagttccacttcaccggctggcccgaccacggcgtgccctaccacgccaccggcctgctgggcttcgtgagacaggtgaagagcaagagcccccccagcgccggccccctggtggtgcactgcagcgccggcgccggcagaaccggctgcttcatcgtgatcgacatcatgctggacatggccgagagagagggcgtggtggacatctacaactgcgtgagagagctgagaagcagaagagtgaacatggtgcagaccgaggagcagtacgtgttcatccacgacgccatcctggaggcctgcctgtgcggcgacaccagcgtgcccgccagccaggtgagaagcctgtactacgacatgaacaagctggacccccagaccaacagcagccagatcaaggaggagttcagaaccctgaacatggtgacccccaccctgagagtggaggactgcagcatcgccctgctgcccagaaaccacgagaagaacagatgcatggacatcctgccccccgacagatgcctgcccttcctgatcaccatcgacggcgagagcagcaactacatcaacgccgccctgatggacagctacaagcagcccagcgccttcatcgtgacccagcaccccctgcccaacaccgtgaaggacttctggagactggtgctggactaccactgcaccagcgtggtgatgctgaacgacgtggaccccgcccagctgtgcccccagtactggcccgagaacggcgtgcacagacacggccccatccaggtggagttcgtgagcgccgacctggaggaggacatcatcagcagaatcttcagaatctacaacgccgccagaccccaggacggctacagaatggtgcagcagttccagttcctgggctggcccatgtacagagacacccccgtgagcaagagaagcttcctgaagctgatcagacaggtggacaagtggcaggaggagtacaacggcggcgagggcagaaccgtggtgcactgcctgaacggcggcggcagaagcggcaccttctgcgccatcagcatcgtgtgcgagatgctgagacaccagagaaccgtggacgtgttccacgccgtgaagaccctgagaaacaacaagcccaacatggtggacctgctggaccagtacaagttctgctacgaggtggccctggagtacctgaacagcggctag

SEQ ID NO: 95563 - DNA, 4173 bp, Artificial Sequence
  Description of Artificial Sequence: Synthetic coding sequence
atgcccagcggcagcttcatgctggtgaacgccagcggcagacccgagggccagagagcccacctgctgctgccccagctgaaggagaacgacacccactgcatcgacttccactacttcgtgagcagcaagagcaacagcccccccggcctgctgaacgtgtacgtgaaggtgaacaacggccccctgggcaaccccatctggaacatcagcggcgaccccaccagaacctggaacagagccgagctggccatcagcaccttctggcccaacttctaccaggtgatcttcgaggtgatcaccagcggccaccagggctacctggccatcgacgaggtgaaggtgctgggccacccctgcaccagaaccccccacttcctgagaatccagaacgtggaggtgaacgccggccagttcgccaccttccagtgcagcgccatcggcagaaccgtggccggcgacagactgtggctgcagggcatcgacgtgagagacgcccccctgaaggagatcaaggtgaccagcagcagaagattcatcgccagcttcaacgtggtgaacaccaccaagagagacgccggcaagtacagatgcatgatcagaaccgagggcggcgtgggcatcagcaactacgccgagctggtggtgaaggagccccccgtgcccatcgcccccccccagctggccagcgtgggcgccacctacctgtggatccagctgaacgccaacagcatcaacggcgacggccccatcgtggccagagaggtggagtactgcaccgccagcggcagctggaacgacagacagcccgtggacagcaccagctacaagatcggccacctggaccccgacaccgagtacgagatcagcgtgctgctgaccagacccggcgagggcggcaccggcagccccggccccgccctgagaaccagaaccaagtgcgccgaccccatgagaggccccagaaagctggaggtggtggaggtgaagagcagacagatcaccatcagatgggagcccttcggctacaacgtgaccagatgccacagctacaacctgaccgtgcactactgctaccaggtgggcggccaggagcaggtgagagaggaggtgagctgggacaccgagaacagccacccccagcacaccatcaccaacctgagcccctacaccaacgtgagcgtgaagctgatcctgatgaaccccgagggcagaaaggagagccaggagctgatcgtgcagaccgacgaggacctgcccggcgccgtgcccaccgagagcatccagggcagcaccttcgaggagaagatcttcctgcagtggagagagcccacccagacctacggcgtgatcaccctgtacgagatcacctacaaggccgtgagcagcttcgaccccgagatcgacctgagcaaccagagcggcagagtgagcaagctgggcaacgagacccacttcctgttcttcggcctgtaccccggcaccacctacagcttcaccatcagagccagcaccgccaagggcttcggcccccccgccaccaaccagttcaccaccaagatcagcgcccccagcatgcccgcctacgagctggagacccccctgaaccagaccgacaacaccgtgaccgtgatgctgaagcccgcccacagcagaggcgcccccgtgagcgtgtaccagatcgtggtggaggaggagagacccagaagaaccaagaagaccaccgagatcctgaagtgctaccccgtgcccatccacttccagaacgccagcctgctgaacagccagtactacttcgccgccgagttccccgccgacagcctgcaggccgcccagcccttcaccatcggcgacaacaagacctacaacggctactggaacacccccctgctgccctacaagagctacagaatctacttccaggccgccagcagagccaacggcgagaccaagatcgactgcgtgcaggtggccaccaagggcgccgccacccccaagcccgtgcccgagcccgagaagcagaccgaccacaccgtgaagatcgccggcgtgatcgccggcatcctgctgttcgtgatcatcttcctgggcgtggtgctggtgatgaagaagagaaagctggccaagaagagaaaggagaccatgagcagcaccagacaggagatgaccgtgatggtgaacagcatggacaagagctacgccgagcagggcaccaactgcgacgaggccttcagcttcatggacacccacaacctgaacggcagaagcgtgagcagccccagcagcttcaccatgaagaccaacaccctgagcaccagcgtgcccaacagctactaccccgacgagacccacaccatggccagcgacaccagcagcctggtgcagagccacacctacaagaagagagagcccgccgacgtgccctaccagaccggccagctgcaccccgccatcagagtggccgacctgctgcagcacatcacccagatgaagtgcgccgagggctacggcttcaaggaggagtacgagagcttcttcgagggccagagcgccccctgggacagcgccaagaaggacgagaacagaatgaagaacagatacggcaacatcatcgcctacgaccacagcagagtgagactgcagaccatcgagggcgacaccaacagcgactacatcaacggcaactacatcgacggctaccacagacccaaccactacatcgccacccagggccccatgcaggagaccatctacgacttctggagaatggtgtggcacgagaacaccgccagcatcatcatggtgaccaacctggtggaggtgggcagagtgaagtgctgcaagtactggcccgacgacaccgagatctacaaggacatcaaggtgaccctgatcgagaccgagctgctggccgagtacgtgatcagaaccttcgccgtggagaagagaggcgtgcacgagatcagagagatcagacagttccacttcaccggctggcccgaccacggcgtgccctaccacgccaccggcctgctgggcttcgtgagacaggtgaagagcaagagcccccccagcgccggccccctggtggtgcactgcagcgccggcgccggcagaaccggctgcttcatcgtgatcgacatcatgctggacatggccgagagagagggcgtggtggacatctacaactgcgtgagagagctgagaagcagaagagtgaacatggtgcagaccgaggagcagtacgtgttcatccacgacgccatcctggaggcctgcctgtgcggcgacaccagcgtgcccgccagccaggtgagaagcctgtactacgacatgaacaagctggacccccagaccaacagcagccagatcaaggaggagttcagaaccctgaacatggtgacccccaccctgagagtggaggactgcagcatcgccctgctgcccagaaaccacgagaagaacagatgcatggacatcctgccccccgacagatgcctgcccttcctgatcaccatcgacggcgagagcagcaactacatcaacgccgccctgatggacagctacaagcagcccagcgccttcatcgtgacccagcaccccctgcccaacaccgtgaaggacttctggagactggtgctggactaccactgcaccagcgtggtgatgctgaacgacgtggaccccgcccagctgtgcccccagtactggcccgagaacggcgtgcacagacacggccccatccaggtggagttcgtgagcgccgacctggaggaggacatcatcagcagaatcttcagaatctacaacgccgccagaccccaggacggctacagaatggtgcagcagttccagttcctgggctggcccatgtacagagacacccccgtgagcaagagaagcttcctgaagctgatcagacaggtggacaagtggcaggaggagtacaacggcggcgagggcagaaccgtggtgcactgcctgaacggcggcggcagaagcggcaccttctgcgccatcagcatcgtgtgcgagatgctgagacaccagagaaccgtggacgtgttccacgccgtgaagaccctgagaaacaacaagcccaacatggtggacctgctggaccagtacaagttctgctacgaggtggccctggagtacctgaacagcggctag

SEQ ID NO: 95564 - DNA, 4401 bp, Artificial Sequence
  Description of Artificial Sequence: Synthetic coding sequence
atgagaggcctgggcacctgcctggccaccctggccggcctgctgctgaccgccgccggcgagaccttcagcggcggctgcctgttcgacgagccctacagcacctgcggctacagccagagcgagggcgacgacttcaactgggagcaggtgaacaccctgaccaagcccaccagcgacccctggatgcccagcggcagcttcatgctggtgaacgccagcggcagacccgagggccagagagcccacctgctgctgccccagctgaaggagaacgacacccactgcatcgacttccactacttcgtgagcagcaagagcaacagcccccccggcctgctgaacgtgtacgtgaaggtgaacaacggccccctgggcaaccccatctggaacatcagcggcgaccccaccagaacctggaacagagccgagctggccatcagcaccttctggcccaacttctaccaggtgatcttcgaggtgatcaccagcggccaccagggctacctggccatcgacgaggtgaaggtgctgggccacccctgcaccagaaccccccacttcctgagaatccagaacgtggaggtgaacgccggccagttcgccaccttccagtgcagcgccatcggcagaaccgtggccggcgacagactgtggctgcagggcatcgacgtgagagacgcccccctgaaggagatcaaggtgaccagcagcagaagattcatcgccagcttcaacgtggtgaacaccaccaagagagacgccggcaagtacagatgcatgatcagaaccgagggcggcgtgggcatcagcaactacgccgagctggtggtgaaggagccccccgtgcccatcgcccccccccagctggccagcgtgggcgccacctacctgtggatccagctgaacgccaacagcatcaacggcgacggccccatcgtggccagagaggtggagtactgcaccgccagcggcagctggaacgacagacagcccgtggacagcaccagctacaagatcggccacctggaccccgacaccgagtacgagatcagcgtgctgctgaccagacccggcgagggcggcaccggcagccccggccccgccctgagaaccagaaccaagtgcgccgaccccatgagaggccccagaaagctggaggtggtggaggtgaagagcagacagatcaccatcagatgggagcccttcggctacaacgtgaccagatgccacagctacaacctgaccgtgcactactgctaccaggtgggcggccaggagcaggtgagagaggaggtgagctgggacaccgagaacagccacccccagcacaccatcaccaacctgagcccctacaccaacgtgagcgtgaagctgatcctgatgaaccccgagggcagaaaggagagccaggagctgatcgtgcagaccgacgaggacctgcccggcgccgtgcccaccgagagcatccagggcagcaccttcgaggagaagatcttcctgcagtggagagagcccacccagacctacggcgtgatcaccctgtacgagatcacctacaaggccgtgagcagcttcgaccccgagatcgacctgagcaaccagagcggcagagtgagcaagctgggcaacgagacccacttcctgttcttcggcctgtaccccggcaccacctacagcttcaccatcagagccagcaccgccaagggcttcggcccccccgccaccaaccagttcaccaccaagatcagcgcccccagcatgcccgcctacgagctggagacccccctgaaccagaccgacaacaccgtgaccgtgatgctgaagcccgcccacagcagaggcgcccccgtgagcgtgtaccagatcgtggtggaggaggagagacccagaagaaccaagaagaccaccgagatcctgaagtgctaccccgtgcccatccacttccagaacgccagcctgctgaacagccagtactacttcgccgccgagttccccgccgacagcctgcaggccgcccagcccttcaccatcggcgacaacaagacctacaacggctactggaacacccccctgctgccctacaagagctacagaatctacttccaggccgccagcagagccaacggcgagaccaagatcgactgcgtgcaggtggccaccaagggcgccgccacccccaagcccgtgcccgagcccgagaagcagaccgaccacaccgtgaagatcgccggcgtgatcgccggcatcctgctgttcgtgatcatcttcctgggcgtggtgctggtgatgaagaagagaaagctggccaagaagagaaaggagaccatgagcagcaccagacaggagatgaccgtgatggtgaacagcatggacaagagctacgccgagcagggcaccaactgcgacgaggccttcagcttcatggacacccacaacctgaacggcagaagcgtgagcagccccagcagcttcaccatgaagaccaacaccctgagcaccagcgtgcccaacagctactaccccgaccccttcgtgcccaccgccatcctggacttcagcctgaacaacgagacccacaccatggccagcgacaccagcagcctggtgcagagccacacctacaagaagagagagcccgccgacgtgccctaccagaccggccagctgcaccccgccatcagagtggccgacctgctgcagcacatcacccagatgaagtgcgccgagggctacggcttcaaggaggagtacgagagcttcttcgagggccagagcgccccctgggacagcgccaagaaggacgagaacagaatgaagaacagatacggcaacatcatcgcctacgaccacagcagagtgagactgcagaccatcgagggcgacaccaacagcgactacatcaacggcaactacatcgacggctaccacagacccaaccactacatcgccacccagggccccatgcaggagaccatctacgacttctggagaatggtgtggcacgagaacaccgccagcatcatcatggtgaccaacctggtggaggtgggcagagtgaagtgctgcaagtactggcccgacgacaccgagatctacaaggacatcaaggtgaccctgatcgagaccgagctgctggccgagtacgtgatcagaaccttcgccgtggagaagagaggcgtgcacgagatcagagagatcagacagttccacttcaccggctggcccgaccacggcgtgccctaccacgccaccggcctgctgggcttcgtgagacaggtgaagagcaagagcccccccagcgccggccccctggtggtgcactgcagcgccggcgccggcagaaccggctgcttcatcgtgatcgacatcatgctggacatggccgagagagagggcgtggtggacatctacaactgcgtgagagagctgagaagcagaagagtgaacatggtgcagaccgaggagcagtacgtgttcatccacgacgccatcctggaggcctgcctgtgcggcgacaccagcgtgcccgccagccaggtgagaagcctgtactacgacatgaacaagctggacccccagaccaacagcagccagatcaaggaggagttcagaaccctgaacatggtgacccccaccctgagagtggaggactgcagcatcgccctgctgcccagaaaccacgagaagaacagatgcatggacatcctgccccccgacagatgcctgcccttcctgatcaccatcgacggcgagagcagcaactacatcaacgccgccctgatggacagctacaagcagcccagcgccttcatcgtgacccagcaccccctgcccaacaccgtgaaggacttctggagactggtgctggactaccactgcaccagcgtggtgatgctgaacgacgtggaccccgcccagctgtgcccccagtactggcccgagaacggcgtgcacagacacggccccatccaggtggagttcgtgagcgccgacctggaggaggacatcatcagcagaatcttcagaatctacaacgccgccagaccccaggacggctacagaatggtgcagcagttccagttcctgggctggcccatgtacagagacacccccgtgagcaagagaagcttcctgaagctgatcagacaggtggacaagtggcaggaggagtacaacggcggcgagggcagaaccgtggtgcactgcctgaacggcggcggcagaagcggcaccttctgcgccatcagcatcgtgtgcgagatgctgagacaccagagaaccgtggacgtgttccacgccgtgaagaccctgagaaacaacaagcccaacatggtggacctgctggaccagtacaagttctgctacgaggtggccctggagtacctgaacagcggctag

SEQ ID NO: 95565 - DNA, 3720 bp, Artificial Sequence
  Description of Artificial Sequence: Synthetic coding sequence
atgggcaccctgagcctgcaccccggcatcgacgtgagagacgcccccctgaaggagatcaaggtgaccagcagcagaagattcatcgccagcttcaacgtggtgaacaccaccaagagagacgccggcaagtacagatgcatgatcagaaccgagggcggcgtgggcatcagcaactacgccgagctggtggtgaaggagccccccgtgcccatcgcccccccccagctggccagcgtgggcgccacctacctgtggatccagctgaacgccaacagcatcaacggcgacggccccatcgtggccagagaggtggagtactgcaccgccagcggcagctggaacgacagacagcccgtggacagcaccagctacaagatcggccacctggaccccgacaccgagtacgagatcagcgtgctgctgaccagacccggcgagggcggcaccggcagccccggccccgccctgagaaccagaaccaagtgcgccgaccccatgagaggccccagaaagctggaggtggtggaggtgaagagcagacagatcaccatcagatgggagcccttcggctacaacgtgaccagatgccacagctacaacctgaccgtgcactactgctaccaggtgggcggccaggagcaggtgagagaggaggtgagctgggacaccgagaacagccacccccagcacaccatcaccaacctgagcccctacaccaacgtgagcgtgaagctgatcctgatgaaccccgagggcagaaaggagagccaggagctgatcgtgcagaccgacgaggacctgcccggcgccgtgcccaccgagagcatccagggcagcaccttcgaggagaagatcttcctgcagtggagagagcccacccagacctacggcgtgatcaccctgtacgagatcacctacaaggccgtgagcagcttcgaccccgagatcgacctgagcaaccagagcggcagagtgagcaagctgggcaacgagacccacttcctgttcttcggcctgtaccccggcaccacctacagcttcaccatcagagccagcaccgccaagggcttcggcccccccgccaccaaccagttcaccaccaagatcagcgcccccagcatgcccgcctacgagctggagacccccctgaaccagaccgacaacaccgtgaccgtgatgctgaagcccgcccacagcagaggcgcccccgtgagcgtgtaccagatcgtggtggaggaggagagacccagaagaaccaagaagaccaccgagatcctgaagtgctaccccgtgcccatccacttccagaacgccagcctgctgaacagccagtactacttcgccgccgagttccccgccgacagcctgcaggccgcccagcccttcaccatcggcgacaacaagacctacaacggctactggaacacccccctgctgccctacaagagctacagaatctacttccaggccgccagcagagccaacggcgagaccaagatcgactgcgtgcaggtggccaccaagggcgccgccacccccaagcccgtgcccgagcccgagaagcagaccgaccacaccgtgaagatcgccggcgtgatcgccggcatcctgctgttcgtgatcatcttcctgggcgtggtgctggtgatgaagaagagaaagctggccaagaagagaaaggagaccatgagcagcaccagacaggagatgaccgtgatggtgaacagcatggacaagagctacgccgagcagggcaccaactgcgacgaggccttcagcttcatggacacccacaacctgaacggcagaagcgtgagcagccccagcagcttcaccatgaagaccaacaccctgagcaccagcgtgcccaacagctactaccccgacgagacccacaccatggccagcgacaccagcagcctggtgcagagccacacctacaagaagagagagcccgccgacgtgccctaccagaccggccagctgcaccccgccatcagagtggccgacctgctgcagcacatcacccagatgaagtgcgccgagggctacggcttcaaggaggagtacgagagcttcttcgagggccagagcgccccctgggacagcgccaagaaggacgagaacagaatgaagaacagatacggcaacatcatcgcctacgaccacagcagagtgagactgcagaccatcgagggcgacaccaacagcgactacatcaacggcaactacatcgacggctaccacagacccaaccactacatcgccacccagggccccatgcaggagaccatctacgacttctggagaatggtgtggcacgagaacaccgccagcatcatcatggtgaccaacctggtggaggtgggcagagtgaagtgctgcaagtactggcccgacgacaccgagatctacaaggacatcaaggtgaccctgatcgagaccgagctgctggccgagtacgtgatcagaaccttcgccgtggagaagagaggcgtgcacgagatcagagagatcagacagttccacttcaccggctggcccgaccacggcgtgccctaccacgccaccggcctgctgggcttcgtgagacaggtgaagagcaagagcccccccagcgccggccccctggtggtgcactgcagcgccggcgccggcagaaccggctgcttcatcgtgatcgacatcatgctggacatggccgagagagagggcgtggtggacatctacaactgcgtgagagagctgagaagcagaagagtgaacatggtgcagaccgaggagcagtacgtgttcatccacgacgccatcctggaggcctgcctgtgcggcgacaccagcgtgcccgccagccaggtgagaagcctgtactacgacatgaacaagctggacccccagaccaacagcagccagatcaaggaggagttcagaaccctgaacatggtgacccccaccctgagagtggaggactgcagcatcgccctgctgcccagaaaccacgagaagaacagatgcatggacatcctgccccccgacagatgcctgcccttcctgatcaccatcgacggcgagagcagcaactacatcaacgccgccctgatggacagctacaagcagcccagcgccttcatcgtgacccagcaccccctgcccaacaccgtgaaggacttctggagactggtgctggactaccactgcaccagcgtggtgatgctgaacgacgtggaccccgcccagctgtgcccccagtactggcccgagaacggcgtgcacagacacggccccatccaggtggagttcgtgagcgccgacctggaggaggacatcatcagcagaatcttcagaatctacaacgccgccagaccccaggacggctacagaatggtgcagcagttccagttcctgggctggcccatgtacagagacacccccgtgagcaagagaagcttcctgaagctgatcagacaggtggacaagtggcaggaggagtacaacggcggcgagggcagaaccgtggtgcactgcctgaacggcggcggcagaagcggcaccttctgcgccatcagcatcgtgtgcgagatgctgagacaccagagaaccgtggacgtgttccacgccgtgaagaccctgagaaacaacaagcccaacatggtggacctgctggaccagtacaagttctgctacgaggtggccctggagtacctgaacagcggctag

SEQ ID NO: 95566 - DNA, 2940 bp, Artificial Sequence
  Description of Artificial Sequence: Synthetic coding sequence
atgagaagacccagaagacccggcggcctgggcggcagcggcggcctgagactgctgctgtgcctgctgctgctgagcagcagacccggcggctgcagcgccgtgagcgcccacggctgcctgttcgacagaagactgtgcagccacctggaggtgtgcatccaggacggcctgttcggccagtgccaggtgggcgtgggccaggccagacccctgctgcaggtgaccagccccgtgctgcagagactgcagggcgtgctgagacagctgatgagccagggcctgagctggcacgacgacctgacccagtacgtgatcagccaggagatggagagaatccccagactgagaccccccgagcccagacccagagacagaagcggcctggcccccaagagacccggccccgccggcgagctgctgctgcaggacatccccaccggcagcgcccccgccgcccagcacagactgccccagccccccgtgggcaagggcggcgccggcgccagcagcagcctgagccccctgcaggccgagctgctgccccccctgctggagcacctgctgctgcccccccagcccccccaccccagcctgagctacgagcccgccctgctgcagccctacctgttccaccagttcggcagcagagacggcagcagagtgagcgagggcagccccggcatggtgagcgtgggccccctgcccaaggccgaggcccccgccctgttcagcagaaccgccagcaagggcatcttcggcgaccaccccggccacagctacggcgacctgcccggccccagccccgcccagctgttccaggacagcggcctgctgtacctggcccaggagctgcccgcccccagcagagccagagtgcccagactgcccgagcagggcagcagcagcagagccgaggacagccccgagggctacgagaaggagggcctgggcgacagaggcgagaagcccgccagccccgccgtgcagcccgacgccgccctgcagagactggccgccgtgctggccggctacggcgtggagctgagacagctgacccccgagcagctgagcaccctgctgaccctgctgcagctgctgcccaagggcgccggcagaaaccccggcggcgtggtgaacgtgggcgccgacatcaagaagaccatggagggccccgtggagggcagagacaccgccgagctgcccgccagaaccagccccatgcccggccaccccaccgccagccccaccagcagcgaggtgcagcaggtgcccagccccgtgagcagcgagccccccaaggccgccagaccccccgtgacccccgtgctgctggagaagaagagccccctgggccagagccagcccaccgtggccggccagcccagcgccagacccgccgccgaggagtacggctacatcgtgaccgaccagaagcccctgagcctggccgccggcgtgaagctgctggagatcctggccgagcacgtgcacatgagcagcggcagcttcatcaacatcagcgtggtgggccccgccctgaccttcagaatcagacacaacgagcagaacctgagcctggccgacgtgacccagcaggccggcctggtgaagagcgagctggaggcccagaccggcctgcagatcctgcagaccggcgtgggccagagagaggaggccgccgccgtgctgccccagaccgcccacagcaccagccccatgagaagcgtgctgctgaccctggtggccctggccggcgtggccggcctgctggtggccctggccgtggccctgtgcgtgagacagcacgccagacagcaggacaaggagagactggccgccctgggccccgagggcgcccacggcgacaccaccttcgagtaccaggacctgtgcagacagcacatggccaccaagagcctgttcaacagagccgagggcccccccgagcccagcagagtgagcagcgtgagcagccagttcagcgacgccgcccaggccagccccagcagccacagcagcacccccagctggtgcgaggagcccgcccaggccaacatggacatcagcaccggccacatgatcctggcctacatggaggaccacctgagaaacagagacagactggccaaggagtggcaggccctgtgcgcctaccaggccgagcccaacacctgcgccaccgcccagggcgagggcaacatcaagaagaacagacaccccgacttcctgccctacgaccacgccagaatcaagctgaaggtggagagcagccccagcagaagcgactacatcaacgccagccccatcatcgagcacgaccccagaatgcccgcctacatcgccacccagggccccctgagccacaccatcgccgacttctggcagatggtgtgggagagcggctgcaccgtgatcgtgatgctgacccccctggtggaggacggcgtgaagcagtgcgacagatactggcccgacgagggcgccagcctgtaccacgtgtacgaggtgaacctggtgagcgagcacatctggtgcgaggacttcctggtgagaagcttctacctgaagaacgtgcagacccaggagaccagaaccctgacccagttccacttcctgagctggcccgccgagggcacccccgccagcaccagacccctgctggacttcagaagaaaggtgaacaagtgctacagaggcagaagctgccccatcatcgtgcactgcagcgacggcgccggcagaaccggcacctacatcctgatcgacatggtgctgaacagaatggccaagggcgtgaaggagatcgacatcgccgccaccctggagcacgtgagagaccagagacccggcctggtgagaagcaaggaccagttcgagttcgccctgaccgccgtggccgaggaggtgaacgccatcctgaaggccctgccccagtag

SEQ ID NO: 95567 - DNA, 2853 bp, Artificial Sequence
  Description of Artificial Sequence: Synthetic coding sequence
atgagaagacccagaagacccggcggcctgggcggcagcggcggcctgagactgctgctgtgcctgctgctgctgagcagcagacccggcggctgcagcgccgtgagcgcccacggctgcctgttcgacagaagactgtgcagccacctggaggtgtgcatccaggacggcctgttcggccagtgccaggtgggcgtgggccaggccagacccctgctgcaggtgaccagccccgtgctgcagagactgcagggcgtgctgagacagctgatgagccagggcctgagctggcacgacgacctgacccagtacgtgatcagccaggagatggagagaatccccagactgagaccccccgagcccagacccagagacagaagcggcctggcccccaagagacccggccccgccggcgagctgctgctgcaggacatccccaccggcagcgcccccgccgcccagcacagactgccccagccccccgtgggcaagggcggcgccggcgccagcagcagcctgagccccctgcaggccgagctgctgccccccctgctggagcacctgctgctgcccccccagcccccccaccccagcctgagctacgagcccgccctgctgcagccctacctgttccaccagttcggcagcagagacggcagcagagtgagcgagggcagccccggcatggtgagcgtgggccccctgcccaaggccgaggcccccgccctgttcagcagaaccgccagcaagggcatcttcggcgaccaccccggccacagctacggcgacctgcccggccccagccccgcccagctgttccaggacagcggcctgctgtacctggcccaggagctgcccgcccccagcagagccagagtgcccagactgcccgagcagggcagcagcagcagagccgaggacagccccgagggctacgagaaggagggcctgggcgacagaggcgagaagcccgccagccccgccgtgcagcccgacgccgccctgcagagactggccgccgtgctggccggctacggcgtggagctgagacagctgacccccgagcagctgagcaccctgctgaccctgctgcagctgctgcccaagggcgccggcagaaaccccggcggcgtggtgaacgtgggcgccgacatcaagaagaccatggagggccccgtggagggcagagacaccgccgagctgcccgccagaaccagccccatgcccggccaccccaccgccagccccaccagcagcgaggtgcagcaggtgcccagccccgtgagcagcgagccccccaaggccgccagaccccccgtgacccccgtgctgctggagaagaagagccccctgggccagagccagcccaccgtggccggccagcccagcgccagacccgccgccgaggagtacggctacatcgtgaccgaccagaacgtggtgggccccgccctgaccttcagaatcagacacaacgagcagaacctgagcctggccgacgtgacccagcaggccggcctggtgaagagcgagctggaggcccagaccggcctgcagatcctgcagaccggcgtgggccagagagaggaggccgccgccgtgctgccccagaccgcccacagcaccagccccatgagaagcgtgctgctgaccctggtggccctggccggcgtggccggcctgctggtggccctggccgtggccctgtgcgtgagacagcacgccagacagcaggacaaggagagactggccgccctgggccccgagggcgcccacggcgacaccaccttcgagtaccaggacctgtgcagacagcacatggccaccaagagcctgttcaacagagccgagggcccccccgagcccagcagagtgagcagcgtgagcagccagttcagcgacgccgcccaggccagccccagcagccacagcagcacccccagctggtgcgaggagcccgcccaggccaacatggacatcagcaccggccacatgatcctggcctacatggaggaccacctgagaaacagagacagactggccaaggagtggcaggccctgtgcgcctaccaggccgagcccaacacctgcgccaccgcccagggcgagggcaacatcaagaagaacagacaccccgacttcctgccctacgaccacgccagaatcaagctgaaggtggagagcagccccagcagaagcgactacatcaacgccagccccatcatcgagcacgaccccagaatgcccgcctacatcgccacccagggccccctgagccacaccatcgccgacttctggcagatggtgtgggagagcggctgcaccgtgatcgtgatgctgacccccctggtggaggacggcgtgaagcagtgcgacagatactggcccgacgagggcgccagcctgtaccacgtgtacgaggtgaacctggtgagcgagcacatctggtgcgaggacttcctggtgagaagcttctacctgaagaacgtgcagacccaggagaccagaaccctgacccagttccacttcctgagctggcccgccgagggcacccccgccagcaccagacccctgctggacttcagaagaaaggtgaacaagtgctacagaggcagaagctgccccatcatcgtgcactgcagcgacggcgccggcagaaccggcacctacatcctgatcgacatggtgctgaacagaatggccaagggcgtgaaggagatcgacatcgccgccaccctggagcacgtgagagaccagagacccggcctggtgagaagcaaggaccagttcgagttcgccctgaccgccgtggccgaggaggtgaacgccatcctgaaggccctgccccagtag

SEQ ID NO: 95568 - DNA, 489 bp, Artificial Sequence
  Description of Artificial Sequence: Synthetic coding sequence
atgagaagacccagaagacccggcggcctgggcggcagcggcggcctgagactgctgctgtgcctgctgctgctgagcagcagacccggcggctgcagcgccgtgagcgcccacggctgcctgttcgacagaagactgtgcagccacctggaggtgtgcatccaggacggcctgttcggccagtgccaggtgggcgtgggccaggccagacccctgctgcaggtgaccagccccgtgctgcagagactgcagggcgtgctgagacagctgatgagccagggcctgagctggcacgacgacctgacccagtacgtgatcagccaggagatggagagaatccccagactgagaccccccgagcccagacccagagacagaagcggcctggcccccaagagacccggccccgccggcgagctgctgctgcaggacatccccaccggcagcgcccccgccgcccagctgctgagcgtgcccagcgccggctag

SEQ ID NO: 95569 - DNA, 2670 bp, Artificial Sequence
  Description of Artificial Sequence: Synthetic coding sequence
atgagccagggcctgagctggcacgacgacctgacccagtacgtgatcagccaggagatggagagaatccccagactgagaccccccgagcccagacccagagacagaagcggcctggcccccaagagacccggccccgccggcgagctgctgctgcaggacatccccaccggcagcgcccccgccgcccagcacagactgccccagccccccgtgggcaagggcggcgccggcgccagcagcagcctgagccccctgcaggccgagctgctgccccccctgctggagcacctgctgctgcccccccagcccccccaccccagcctgagctacgagcccgccctgctgcagccctacctgttccaccagttcggcagcagagacggcagcagagtgagcgagggcagccccggcatggtgagcgtgggccccctgcccaaggccgaggcccccgccctgttcagcagaaccgccagcaagggcatcttcggcgaccaccccggccacagctacggcgacctgcccggccccagccccgcccagctgttccaggacagcggcctgctgtacctggcccaggagctgcccgcccccagcagagccagagtgcccagactgcccgagcagggcagcagcagcagagccgaggacagccccgagggctacgagaaggagggcctgggcgacagaggcgagaagcccgccagccccgccgtgcagcccgacgccgccctgcagagactggccgccgtgctggccggctacggcgtggagctgagacagctgacccccgagcagctgagcaccctgctgaccctgctgcagctgctgcccaagggcgccggcagaaaccccggcggcgtggtgaacgtgggcgccgacatcaagaagaccatggagggccccgtggagggcagagacaccgccgagctgcccgccagaaccagccccatgcccggccaccccaccgccagccccaccagcagcgaggtgcagcaggtgcccagccccgtgagcagcgagccccccaaggccgccagaccccccgtgacccccgtgctgctggagaagaagagccccctgggccagagccagcccaccgtggccggccagcccagcgccagacccgccgccgaggagtacggctacatcgtgaccgaccagaagcccctgagcctggccgccggcgtgaagctgctggagatcctggccgagcacgtgcacatgagcagcggcagcttcatcaacatcagcgtggtgggccccgccctgaccttcagaatcagacacaacgagcagaacctgagcctggccgacgtgacccagcaggccggcctggtgaagagcgagctggaggcccagaccggcctgcagatcctgcagaccggcgtgggccagagagaggaggccgccgccgtgctgccccagaccgcccacagcaccagccccatgagaagcgtgctgctgaccctggtggccctggccggcgtggccggcctgctggtggccctggccgtggccctgtgcgtgagacagcacgccagacagcaggacaaggagagactggccgccctgggccccgagggcgcccacggcgacaccaccttcgagtaccaggacctgtgcagacagcacatggccaccaagagcctgttcaacagagccgagggcccccccgagcccagcagagtgagcagcgtgagcagccagttcagcgacgccgcccaggccagccccagcagccacagcagcacccccagctggtgcgaggagcccgcccaggccaacatggacatcagcaccggccacatgatcctggcctacatggaggaccacctgagaaacagagacagactggccaaggagtggcaggccctgtgcgcctaccaggccgagcccaacacctgcgccaccgcccagggcgagggcaacatcaagaagaacagacaccccgacttcctgccctacgaccacgccagaatcaagctgaaggtggagagcagccccagcagaagcgactacatcaacgccagccccatcatcgagcacgaccccagaatgcccgcctacatcgccacccagggccccctgagccacaccatcgccgacttctggcagatggtgtgggagagcggctgcaccgtgatcgtgatgctgacccccctggtggaggacggcgtgaagcagtgcgacagatactggcccgacgagggcgccagcctgtaccacgtgtacgaggtgaacctggtgagcgagcacatctggtgcgaggacttcctggtgagaagcttctacctgaagaacgtgcagacccaggagaccagaaccctgacccagttccacttcctgagctggcccgccgagggcacccccgccagcaccagacccctgctggacttcagaagaaaggtgaacaagtgctacagaggcagaagctgccccatcatcgtgcactgcagcgacggcgccggcagaaccggcacctacatcctgatcgacatggtgctgaacagaatggccaagggcgtgaaggagatcgacatcgccgccaccctggagcacgtgagagaccagagacccggcctggtgagaagcaaggaccagttcgagttcgccctgaccgccgtggccgaggaggtgaacgccatcctgaaggccctgccccagtag

SEQ ID NO: 95570 - DNA, 2853 bp, Artificial Sequence; identical to SEQ ID NO: 95567
  Description of Artificial Sequence: Synthetic coding sequence

SEQ ID NO: 95571 - DNA, 2961 bp, Artificial Sequence
  Description of Artificial Sequence: Synthetic coding sequence
atgggcccccccctgcccctgctgctgctgctgctgctgctgctgccccccagagtgctgcccgccgcccccagcagcgtgcccagaggcagacagctgcccggcagactgggctgcctgctggaggagggcctgtgcggcgccagcgaggcctgcgtgaacgacggcgtgttcggcagatgccagaaggtgcccgccatggacttctacagatacgaggtgagccccgtggccctgcagagactgagagtggccctgcagaagctgagcggcaccggcttcacctggcaggacgactacacccagtacgtgatggaccaggagctggccgacctgcccaagacctacctgagaagacccgaggccagcagccccgccagacccagcaagcacagcgtgggcagcgagagaagatacagcagagagggcggcgccgccctggccaacgccctgagaagacacctgcccttcctggaggccctgagccaggcccccgccagcgacgtgctggccagaacccacaccgcccaggacagaccccccgccgagggcgacgacagattcagcgagagcatcctgacctacgtggcccacaccagcgccctgacctacccccccggcagcagaacccagctgagagaggacctgctgcccagaaccctgggccagctgcagcccgacgagctgagccccaaggtggacagcggcgtggacagacaccacctgatggccgccctgagcgcctacgccgcccagagaccccccgccccccccggcgagggcagcctggagccccagtacctgctgagagcccccagcagaatgcccagacccctgctggcccccgccgccccccagaagtggcccagccccctgggcgacagcgaggaccccagcagcaccggcgacggcgccagaatccacaccctgctgaaggacctgcagagacagcccgccgaggtgagaggcctgagcggcctggagctggacggcatggccgagctgatggccggcctgatgcagggcgtggaccacggcgtggccagaggcagccccggcagagccgccctgggcgagagcggcgagcaggccgacggccccaaggccaccctgagaggcgacagcttccccgacgacggcgtgcaggacgacgacgacagactgtaccaggaggtgcacagactgagcgccaccctgggcggcctgctgcaggaccacggcagcagactgctgcccggcgccctgcccttcgccagacccctggacatggagagaaagaagagcgagcaccccgagagcagcctgagcagcgaggaggagaccgccggcgtggagaacgtgaagagccagacctacagcaaggacctgctgggccagcagccccacagcgagcccggcgccgccgccttcggcgagctgcagaaccagatgcccggccccagcaaggaggagcagagcctgcccgccggcgcccaggaggccctgagcgacggcctgcagctggaggtgcagcccagcgaggaggaggccagaggctacatcgtgaccgacagagaggtgctgggccccgccgtgaccttcaaggtgagcgccaacgtgcagaacgtgaccaccgaggacgtggagaaggccaccgtggacaacaaggacaagctggaggagaccagcggcctgaagatcctgcagaccggcgtgggcagcaagagcaagctgaagttcctgcccccccaggccgagcaggaggacagcaccaagttcatcgccctgaccctggtgagcctggcctgcatcctgggcgtgctgctggccagcggcctgatctactgcctgagacacagcagccagcacagactgaaggagaagctgagcggcctgggcggcgaccccggcgccgacgccaccgccgcctaccaggagctgtgcagacagagaatggccaccagaccccccgacagacccgagggcccccacaccagcagaatcagcagcgtgagcagccagttcagcgacggccccatccccagccccagcgccagaagcagcgccagcagctggagcgaggagcccgtgcagagcaacatggacatcagcaccggccacatgatcctgagctacatggaggaccacctgaagaacaagaacagactggagaaggagtgggaggccctgtgcgcctaccaggccgagcccaacagcagcttcgtggcccagagagaggagaacgtgcccaagaacagaagcctggccgtgctgacctacgaccacagcagagtgctgctgaaggccgagaacagccacagccacagcgactacatcaacgccagccccatcatggaccacgaccccagaaaccccgcctacatcgccacccagggccccctgcccgccaccgtggccgacttctggcagatggtgtgggagagcggctgcgtggtgatcgtgatgctgacccccctggccgagaacggcgtgagacagtgctaccactactggcccgacgagggcagcaacctgtaccacatctacgaggtgaacctggtgagcgagcacatctggtgcgaggacttcctggtgagaagcttctacctgaagaacctgcagaccaacgagaccagaaccgtgacccagttccacttcctgagctggtacgacagaggcgtgcccagcagcagcagaagcctgctggacttcagaagaaaggtgaacaagtgctacagaggcagaagctgccccatcatcgtgcactgcagcgacggcgccggcagaagcggcacctacgtgctgatcgacatggtgctgaacaagatggccaagggcgccaaggagatcgacatcgccgccaccctggagcacctgagagaccagagacccggcatggtgcagaccaaggagcagttcgagttcgccctgaccgccgtggccgaggaggtgaacgccatcctgaaggccctgccccagtag

SEQ ID NO: 95572 - DNA, 2997 bp, Artificial Sequence
  Description of Artificial Sequence: Synthetic coding sequence
atgggcccccccctgcccctgctgctgctgctgctgctgctgctgccccccagagtgctgcccgccgcccccagcagcgtgcccagaggcagacagctgcccggcagactggacggcgtgttcggcagatgccagaaggtgcccgccatggacttctacagatacgaggtgagccccgtggccctgcagagactgagagtggccctgcagaagctgagcggcaccggcttcacctggcaggacgactacacccagtacgtgatggaccaggagctggccgacctgcccaagacctacctgagaagacccgaggccagcagccccgccagacccagcaagcacagcgtgggcagcgagagaagatacagcagagagggcggcgccgccctggccaacgccctgagaagacacctgcccttcctggaggccctgagccaggcccccgccagcgacgtgctggccagaacccacaccgcccaggacagaccccccgccgagggcgacgacagattcagcgagagcatcctgacctacgtggcccacaccagcgccctgacctacccccccggcagcagaacccagctgagagaggacctgctgcccagaaccctgggccagctgcagcccgacgagctgagccccaaggtggacagcggcgtggacagacaccacctgatggccgccctgagcgcctacgccgcccagagaccccccgccccccccggcgagggcagcctggagccccagtacctgctgagagcccccagcagaatgcccagacccctgctggcccccgccgccccccagaagtggcccagccccctgggcgacagcgaggaccccagcagcaccggcgacggcgccagaatccacaccctgctgaaggacctgcagagacagcccgccgaggtgagaggcctgagcggcctggagctggacggcatggccgagctgatggccggcctgatgcagggcgtggaccacggcgtggccagaggcagccccggcagagccgccctgggcgagagcggcgagcaggccgacggccccaaggccaccctgagaggcgacagcttccccgacgacggcgtgcaggacgacgacgacagactgtaccaggaggtgcacagactgagcgccaccctgggcggcctgctgcaggaccacggcagcagactgctgcccggcgccctgcccttcgccagacccctggacatggagagaaagaagagcgagcaccccgagagcagcctgagcagcgaggaggagaccgccggcgtggagaacgtgaagagccagacctacagcaaggacctgctgggccagcagccccacagcgagcccggcgccgccgccttcggcgagctgcagaaccagatgcccggccccagcaaggaggagcagagcctgcccgccggcgcccaggaggccctgagcgacggcctgcagctggaggtgcagcccagcgaggaggaggccagaggctacatcgtgaccgacagagaccccctgagacccgaggagggcagaagactggtggaggacgtggccagactgctgcaggtgcccagcagcgccttcgccgacgtggaggtgctgggccccgccgtgaccttcaaggtgagcgccaacgtgcagaacgtgaccaccgaggacgtggagaaggccaccgtggacaacaaggacaagctggaggagaccagcggcctgaagatcctgcagaccggcgtgggcagcaagagcaagctgaagttcctgcccccccaggccgagcaggaggacagcaccaagttcatcgccctgaccctggtgagcctggcctgcatcctgggcgtgctgctggccagcggcctgatctactgcctgagacacagcagccagcacagactgaaggagaagctgagcggcctgggcggcgaccccggcgccgacgccaccgccgcctaccaggagctgtgcagacagagaatggccaccagaccccccgacagacccgagggcccccacaccagcagaatcagcagcgtgagcagccagttcagcgacggccccatccccagccccagcgccagaagcagcgccagcagctggagcgaggagcccgtgcagagcaacatggacatcagcaccggccacatgatcctgagctacatggaggaccacctgaagaacaagaacagactggagaaggagtgggaggccctgtgcgcctaccaggccgagcccaacagcagcttcgtggcccagagagaggagaacgtgcccaagaacagaagcctggccgtgctgacctacgaccacagcagagtgctgctgaaggccgagaacagccacagccacagcgactacatcaacgccagccccatcatggaccacgaccccagaaaccccgcctacatcgccacccagggccccctgcccgccaccgtggccgacttctggcagatggtgtgggagagcggctgcgtggtgatcgtgatgctgacccccctggccgagaacggcgtgagacagtgctaccactactggcccgacgagggcagcaacctgtaccacatctacgaggtgaacctggtgagcgagcacatctggtgcgaggacttcctggtgagaagcttctacctgaagaacctgcagaccaacgagaccagaaccgtgacccagttccacttcctgagctggtacgacagaggcgtgcccagcagcagcagaagcctgctggacttcagaagaaaggtgaacaagtgctacagaggcagaagctgccccatcatcgtgcactgcagcgacggcgccggcagaagcggcacctacgtgctgatcgacatggtgctgaacaagatggccaagggcgccaaggagatcgacatcgccgccaccctggagcacctgagagaccagagacccggcatggtgcagaccaaggagcagttcgagttcgccctgaccgccgtggccgaggaggtgaacgccatcctgaaggccctgccccagtag

SEQ ID NO: 95573 - DNA, 3048 bp, Artificial Sequence
  Description of Artificial Sequence: Synthetic coding sequence
atgggcccccccctgcccctgctgctgctgctgctgctgctgctgccccccagagtgctgcccgccgcccccagcagcgtgcccagaggcagacagctgcccggcagactgggctgcctgctggaggagggcctgtgcggcgccagcgaggcctgcgtgaacgacggcgtgttcggcagatgccagaaggtgcccgccatggacttctacagatacgaggtgagccccgtggccctgcagagactgagagtggccctgcagaagctgagcggcaccggcttcacctggcaggacgactacacccagtacgtgatggaccaggagctggccgacctgcccaagacctacctgagaagacccgaggccagcagccccgccagacccagcaagcacagcgtgggcagcgagagaagatacagcagagagggcggcgccgccctggccaacgccctgagaagacacctgcccttcctggaggccctgagccaggcccccgccagcgacgtgctggccagaacccacaccgcccaggacagaccccccgccgagggcgacgacagattcagcgagagcatcctgacctacgtggcccacaccagcgccctgacctacccccccggcagcagaacccagctgagagaggacctgctgcccagaaccctgggccagctgcagcccgacgagctgagccccaaggtggacagcggcgtggacagacaccacctgatggccgccctgagcgcctacgccgcccagagaccccccgccccccccggcgagggcagcctggagccccagtacctgctgagagcccccagcagaatgcccagacccctgctggcccccgccgccccccagaagtggcccagccccctgggcgacagcgaggaccccagcagcaccggcgacggcgccagaatccacaccctgctgaaggacctgcagagacagcccgccgaggtgagaggcctgagcggcctggagctggacggcatggccgagctgatggccggcctgatgcagggcgtggaccacggcgtggccagaggcagccccggcagagccgccctgggcgagagcggcgagcaggccgacggccccaaggccaccctgagaggcgacagcttccccgacgacggcgtgcaggacgacgacgacagactgtaccaggaggtgcacagactgagcgccaccctgggcggcctgctgcaggaccacggcagcagactgctgcccggcgccctgcccttcgccagacccctggacatggagagaaagaagagcgagcaccccgagagcagcctgagcagcgaggaggagaccgccggcgtggagaacgtgaagagccagacctacagcaaggacctgctgggccagcagccccacagcgagcccggcgccgccgccttcggcgagctgcagaaccagatgcccggccccagcaaggaggagcagagcctgcccgccggcgcccaggaggccctgagcgacggcctgcagctggaggtgcagcccagcgaggaggaggccagaggctacatcgtgaccgacagagaccccctgagacccgaggagggcagaagactggtggaggacgtggccagactgctgcaggtgcccagcagcgccttcgccgacgtggaggtgctgggccccgccgtgaccttcaaggtgagcgccaacgtgcagaacgtgaccaccgaggacgtggagaaggccaccgtggacaacaaggacaagctggaggagaccagcggcctgaagatcctgcagaccggcgtgggcagcaagagcaagctgaagttcctgcccccccaggccgagcaggaggacagcaccaagttcatcgccctgaccctggtgagcctggcctgcatcctgggcgtgctgctggccagcggcctgatctactgcctgagacacagcagccagcacagactgaaggagaagctgagcggcctgggcggcgaccccggcgccgacgccaccgccgcctaccaggagctgtgcagacagagaatggccaccagaccccccgacagacccgagggcccccacaccagcagaatcagcagcgtgagcagccagttcagcgacggccccatccccagccccagcgccagaagcagcgccagcagctggagcgaggagcccgtgcagagcaacatggacatcagcaccggccacatgatcctgagctacatggaggaccacctgaagaacaagaacagactggagaaggagtgggaggccctgtgcgcctaccaggccgagcccaacagcagcttcgtggcccagagagaggagaacgtgcccaagaacagaagcctggccgtgctgacctacgaccacagcagagtgctgctgaaggccgagaacagccacagccacagcgactacatcaacgccagccccatcatggaccacgaccccagaaaccccgcctacatcgccacccagggccccctgcccgccaccgtggccgacttctggcagatggtgtgggagagcggctgcgtggtgatcgtgatgctgacccccctggccgagaacggcgtgagacagtgctaccactactggcccgacgagggcagcaacctgtaccacatctacgaggtgaacctggtgagcgagcacatctggtgcgaggacttcctggtgagaagcttctacctgaagaacctgcagaccaacgagaccagaaccgtgacccagttccacttcctgagctggtacgacagaggcgtgcccagcagcagcagaagcctgctggacttcagaagaaaggtgaacaagtgctacagaggcagaagctgccccatcatcgtgcactgcagcgacggcgccggcagaagcggcacctacgtgctgatcgacatggtgctgaacaagatggccaagggcgccaaggagatcgacatcgccgccaccctggagcacctgagagaccagagacccggcatggtgcagaccaaggagcagttcgagttcgccctgaccgccgtggccgaggaggtgaacgccatcctgaaggccctgccccagtag

SEQ ID NO: 95574 - DNA, 3117 bp, Artificial Sequence
  Description of Artificial Sequence: Synthetic coding sequence
atggccgtggagagcgagtacagcctgctgagaaccgaggccagcttccccaccatgaagatgttctgcgtgagccacaccctgcccagagtggaggtgatgttcgtgagcggcccccagaccagagagagaaccgagcccgtggaccccagatggcagtgcctggtgcagatgtgggccggctgcctgctggaggagggcctgtgcggcgccagcgaggcctgcgtgaacgacggcgtgttcggcagatgccagaaggtgcccgccatggacttctacagatacgaggtgagccccgtggccctgcagagactgagagtggccctgcagaagctgagcggcaccggcttcacctggcaggacgactacacccagtacgtgatggaccaggagctggccgacctgcccaagacctacctgagaagacccgaggccagcagccccgccagacccagcaagcacagcgtgggcagcgagagaagatacagcagagagggcggcgccgccctggccaacgccctgagaagacacctgcccttcctggaggccctgagccaggcccccgccagcgacgtgctggccagaacccacaccgcccaggacagaccccccgccgagggcgacgacagattcagcgagagcatcctgacctacgtggcccacaccagcgccctgacctacccccccggcagcagaacccagctgagagaggacctgctgcccagaaccctgggccagctgcagcccgacgagctgagccccaaggtggacagcggcgtggacagacaccacctgatggccgccctgagcgcctacgccgcccagagaccccccgccccccccggcgagggcagcctggagccccagtacctgctgagagcccccagcagaatgcccagacccctgctggcccccgccgccccccagaagtggcccagccccctgggcgacagcgaggaccccagcagcaccggcgacggcgccagaatccacaccctgctgaaggacctgcagagacagcccgccgaggtgagaggcctgagcggcctggagctggacggcatggccgagctgatggccggcctgatgcagggcgtggaccacggcgtggccagaggcagccccggcagagccgccctgggcgagagcggcgagcaggccgacggccccaaggccaccctgagaggcgacagcttccccgacgacggcgtgcaggacgacgacgacagactgtaccaggaggtgcacagactgagcgccaccctgggcggcctgctgcaggaccacggcagcagactgctgcccggcgccctgcccttcgccagacccctggacatggagagaaagaagagcgagcaccccgagagcagcctgagcagcgaggaggagaccgccggcgtggagaacgtgaagagccagacctacagcaaggacctgctgggccagcagccccacagcgagcccggcgccgccgccttcggcgagctgcagaaccagatgcccggccccagcaaggaggagcagagcctgcccgccggcgcccaggaggccctgagcgacggcctgcagctggaggtgcagcccagcgaggaggaggccagaggctacatcgtgaccgacagagaccccctgagacccgaggagggcagaagactggtggaggacgtggccagactgctgcaggtgcccagcagcgccttcgccgacgtggaggtgctgggccccgccgtgaccttcaaggtgagcgccaacgtgcagaacgtgaccaccgaggacgtggagaaggccaccgtggacaacaaggacaagctggaggagaccagcggcctgaagatcctgcagaccggcgtgggcagcaagagcaagctgaagttcctgcccccccaggccgagcaggaggacagcaccaagttcatcgccctgaccctggtgagcctggcctgcatcctgggcgtgctgctggccagcggcctgatctactgcctgagacacagcagccagcacagactgaaggagaagctgagcggcctgggcggcgaccccggcgccgacgccaccgccgcctaccaggagctgtgcagacagagaatggccaccagaccccccgacagacccgagggcccccacaccagcagaatcagcagcgtgagcagccagttcagcgacggccccatccccagccccagcgccagaagcagcgccagcagctggagcgaggagcccgtgcagagcaacatggacatcagcaccggccacatgatcctgagctacatggaggaccacctgaagaacaagaacagactggagaaggagtgggaggccctgtgcgcctaccaggccgagcccaacagcagcttcgtggcccagagagaggagaacgtgcccaagaacagaagcctggccgtgctgacctacgaccacagcagagtgctgctgaaggccgagaacagccacagccacagcgactacatcaacgccagccccatcatggaccacgaccccagaaaccccgcctacatcgccacccagggccccctgcccgccaccgtggccgacttctggcagatggtgtgggagagcggctgcgtggtgatcgtgatgctgacccccctggccgagaacggcgtgagacagtgctaccactactggcccgacgagggcagcaacctgtaccacatctacgaggtgaacctggtgagcgagcacatctggtgcgaggacttcctggtgagaagcttctacctgaagaacctgcagaccaacgagaccagaaccgtgacccagttccacttcctgagctggtacgacagaggcgtgcccagcagcagcagaagcctgctggacttcagaagaaaggtgaacaagtgctacagaggcagaagctgccccatcatcgtgcactgcagcgacggcgccggcagaagcggcacctacgtgctgatcgacatggtgctgaacaagatggccaagggcgccaaggagatcgacatcgccgccaccctggagcacctgagagaccagagacccggcatggtgcagaccaaggagcagttcgagttcgccctgaccgccgtggccgaggaggtgaacgccatcctgaaggccctgccccagtag

SEQ ID NO: 95575 - DNA, 2934 bp, Artificial Sequence
  Description of Artificial Sequence: Synthetic coding sequence
atgggcccccccctgcccctgctgctgctgctgctgctgctgctgccccccagagtgctgcccgccgcccccagcagcgtgcccagaggcagacagctgcccggcagactgggctgcctgctggaggagggcctgtgcggcgccagcgaggcctgcgtgaacggcttcacctggcaggacgactacacccagtacgtgatggaccaggagctggccgacctgcccaagacctacctgagaagacccgaggccagcagccccgccagacccagcaagcacagcgtgggcagcgagagaagatacagcagagagggcggcgccgccctggccaacgccctgagaagacacctgcccttcctggaggccctgagccaggcccccgccagcgacgtgctggccagaacccacaccgcccaggacagaccccccgccgagggcgacgacagattcagcgagagcatcctgacctacgtggcccacaccagcgccctgacctacccccccggcagcagaacccagctgagagaggacctgctgcccagaaccctgggccagctgcagcccgacgagctgagccccaaggtggacagcggcgtggacagacaccacctgatggccgccctgagcgcctacgccgcccagagaccccccgccccccccggcgagggcagcctggagccccagtacctgctgagagcccccagcagaatgcccagacccctgctggcccccgccgccccccagaagtggcccagccccctgggcgacagcgaggaccccagcagcaccggcgacggcgccagaatccacaccctgctgaaggacctgcagagacagcccgccgaggtgagaggcctgagcggcctggagctggacggcatggccgagctgatggccggcctgatgcagggcgtggaccacggcgtggccagaggcagccccggcagagccgccctgggcgagagcggcgagcaggccgacggccccaaggccaccctgagaggcgacagcttccccgacgacggcgtgcaggacgacgacgacagactgtaccaggaggtgcacagactgagcgccaccctgggcggcctgctgcaggaccacggcagcagactgctgcccggcgccctgcccttcgccagacccctggacatggagagaaagaagagcgagcaccccgagagcagcctgagcagcgaggaggagaccgccggcgtggagaacgtgaagagccagacctacagcaaggacctgctgggccagcagccccacagcgagcccggcgccgccgccttcggcgagctgcagaaccagatgcccggccccagcaaggaggagcagagcctgcccgccggcgcccaggaggccctgagcgacggcctgcagctggaggtgcagcccagcgaggaggaggccagaggctacatcgtgaccgacagagaccccctgagacccgaggagggcagaagactggtggaggacgtggccagactgctgcaggtgcccagcagcgccttcgccgacgtggaggtgctgggccccgccgtgaccttcaaggtgagcgccaacgtgcagaacgtgaccaccgaggacgtggagaaggccaccgtggacaacaaggacaagctggaggagaccagcggcctgaagatcctgcagaccggcgtgggcagcaagagcaagctgaagttcctgcccccccaggccgagcaggaggacagcaccaagttcatcgccctgaccctggtgagcctggcctgcatcctgggcgtgctgctggccagcggcctgatctactgcctgagacacagcagccagcacagactgaaggagaagctgagcggcctgggcggcgaccccggcgccgacgccaccgccgcctaccaggagctgtgcagacagagaatggccaccagaccccccgacagacccgagggcccccacaccagcagaatcagcagcgtgagcagccagttcagcgacggccccatccccagccccagcgccagaagcagcgccagcagctggagcgaggagcccgtgcagagcaacatggacatcagcaccggccacatgatcctgagctacatggaggaccacctgaagaacaagaacagactggagaaggagtgggaggccctgtgcgcctaccaggccgagcccaacagcagcttcgtggcccagagagaggagaacgtgcccaagaacagaagcctggccgtgctgacctacgaccacagcagagtgctgctgaaggccgagaacagccacagccacagcgactacatcaacgccagccccatcatggaccacgaccccagaaaccccgcctacatcgccacccagggccccctgcccgccaccgtggccgacttctggcagatggtgtgggagagcggctgcgtggtgatcgtgatgctgacccccctggccgagaacggcgtgagacagtgctaccactactggcccgacgagggcagcaacctgtaccacatctacgaggtgaacctggtgagcgagcacatctggtgcgaggacttcctggtgagaagcttctacctgaagaacctgcagaccaacgagaccagaaccgtgacccagttccacttcctgagctggtacgacagaggcgtgcccagcagcagcagaagcctgctggacttcagaagaaaggtgaacaagtgctacagaggcagaagctgccccatcatcgtgcactgcagcgacggcgccggcagaagcggcacctacgtgctgatcgacatggtgctgaacaagatggccaagggcgccaaggagatcgacatcgccgccaccctggagcacctgagagaccagagacccggcatggtgcagaccaaggagcagttcgagttcgccctgaccgccgtggccgaggaggtgaacgccatcctgaaggccctgccccagtag

SEQ ID NO: 95576 - DNA, 3651 bp, Artificial Sequence
  Description of Artificial Sequence: Synthetic coding sequence
atgggccacctgcccaccggcatccacggcgccagaagactgctgcccctgctgtggctgttcgtgctgttcaagaacgccaccgccttccacgtgaccgtgcaggacgacaacaacatcgtggtgagcctggaggccagcgacgtgatcagccccgccagcgtgtacgtggtgaagatcaccggcgagagcaagaactacttcttcgagttcgaggagttcaacagcaccctgcccccccccgtgatcttcaaggccagctaccacggcctgtactacatcatcaccctggtggtggtgaacggcaacgtggtgaccaagcccagcagaagcatcaccgtgctgaccaagcccctgcccgtgaccagcgtgagcatctacgactacaagcccagccccgagaccggcgtgctgttcgagatccactaccccgagaagtacaacgtgttcaccagagtgaacatcagctactgggagggcaaggacttcagaaccatgctgtacaaggacttcttcaagggcaagaccgtgttcaaccactggctgcccggcatgtgctacagcaacatcaccttccagctggtgagcgaggccaccttcaacaagagcaccctggtggagtacagcggcgtgagccacgagcccaagcagcacagaaccgccccctaccccccccagaacatcagcgtgagaatcgtgaacctgaacaagaacaactgggaggagcagagcggcaacttccccgaggagagcttcatgagaagccaggacaccatcggcaaggagaagctgttccacttcaccgaggagacccccgagatccccagcggcaacatcagcagcggctggcccgacttcaacagcagcgactacgagaccaccagccagccctactggtgggacagcgccagcgccgcccccgagagcgaggacgagttcgtgagcgtgctgcccatggagtacgagaacaacagcaccctgagcgagaccgagaagagcaccagcggcagcttcagcttcttccccgtgcagatgatcctgacctggctgccccccaagccccccaccgccttcgacggcttccacatccacatcgagagagaggagaacttcaccgagtacctgatggtggacgaggaggcccacgagttcgtggccgagctgaaggagcccggcaagtacaagctgagcgtgaccaccttcagcagcagcggcagctgcgagaccagaaagagccagagcgccaagagcctgagcttctacatcagccccagcggcgagtggatcgaggagctgaccgagaagccccagcacgtgagcgtgcacgtgctgagcagcaccaccgccctgatgagctggaccagcagccaggagaactacaacagcaccatcgtgagcgtggtgagcctgacctgccagaagcagaaggagagccagagactggagaagcagtactgcacccaggtgaacagcagcaagcccatcatcgagaacctggtgcccggcgcccagtaccaggtggtgatctacctgagaaagggccccctgatcggcccccccagcgaccccgtgaccttcgccatcgtgcccaccggcatcaaggacctgatgctgtaccccctgggccccaccgccgtggtgctgagctggaccagaccctacctgggcgtgttcagaaagtacgtggtggagatgttctacttcaaccccgccaccatgaccagcgagtggaccacctactacgagatcgccgccaccgtgagcctgaccgccagcgtgagaatcgccaacctgctgcccgcctggtactacaacttcagagtgaccatggtgacctggggcgaccccgagctgagctgctgcgacagcagcaccatcagcttcatcaccgcccccgtggcccccgagatcaccagcgtggagtacttcaacagcctgctgtacatcagctggacctacggcgacgacaccaccgacctgagccacagcagaatgctgcactggatggtggtggccgagggcaagaagaagatcaagaagagcgtgaccagaaacgtgatgaccgccatcctgagcctgccccccggcgacatctacaacctgagcgtgaccgcctgcaccgagagaggcagcaacaccagcatgctgagactggtgaagctggagcccgccccccccaagagcctgttcgccgtgaacaagacccagaccagcgtgaccctgctgtgggtggaggagggcgtggccgacttcttcgaggtgttctgccagcaggtgggcagcagccagaagaccaagctgcaggagcccgtggccgtgagcagccacgtggtgaccatcagcagcctgctgcccgccaccgcctacaactgcagcgtgaccagcttcagccacgacagccccagcgtgcccaccttcatcgccgtgagcaccatggtgaccgagatgaaccccaacgtggtggtgatcagcgtgctggccatcctgagcaccctgctgatcggcctgctgctggtgaccctgatcatcctgagaaagaagcacctgcagatggccagagagtgcggcgccggcaccttcgtgaacttcgccagcctggagagagacggcaagctgccctacaactggagaagaagcatcttcgccttcctgaccctgctgcccagctgcctgtggaccgactacctgctggccttctacatcaacccctggagcaagaacggcctgaagaagagaaagctgaccaaccccgtgcagctggacgacttcgacgcctacatcaaggacatggccaaggacagcgactacaagttcagcctgcagttcgaggagctgaagctgatcggcctggacatcccccacttcgccgccgacctgcccctgaacagatgcaagaacagatacaccaacatcctgccctacgacttcagcagagtgagactggtgagcatgaacgaggaggagggcgccgactacatcaacgccaactacatccccggctacaacagcccccaggagtacatcgccacccagggccccctgcccgagaccagaaacgacttctggaagatggtgctgcagcagaagagccagatcatcgtgatgctgacccagtgcaacgagaagagaagagtgaagtgcgaccactactggcccttcaccgaggagcccatcgcctacggcgacatcaccgtggagatgatcagcgaggaggagcaggacgactgggcctgcagacacttcagaatcaactacgccgacgagatgcaggacgtgatgcacttcaactacaccgcctggcccgaccacggcgtgcccaccgccaacgccgccgagagcatcctgcagttcgtgcacatggtgagacagcaggccaccaagagcaagggccccatgatcatccactgcagcgccggcgtgggcagaaccggcaccttcatcgccctggacagactgctgcagcacatcagagaccacgagttcgtggacatcctgggcctggtgagcgagatgagaagctacagaatgagcatggtgcagaccgaggagcagtacatcttcatccaccagtgcgtgcagctgatgtggatgaagaagaagcagcagttctgcatcagcgacgtgatctacgagaacgtgagcaagagctag

SEQ ID NO: 95577 - DNA, 3567 bp, Artificial Sequence
  Description of Artificial Sequence: Synthetic coding sequence
atgggccacctgcccaccggcatccacggcgccagaagactgctgcccctgctgtggctgttcgtgctgttcaagaacgccaccgccttccacgtgaccgtgcaggacgacaacaacatcgtggtgagcctggaggccagcgacgtgatcagccccgccagcgtgtacgtggtgaagatcaccggcgagagcaagaactacttcttcgagttcgaggagttcaacagcaccctgcccccccccgtgatcttcaaggccagctaccacggcctgtactacatcatcaccctggtggtggtgaacggcaacgtggtgaccaagcccagcagaagcatcaccgtgctgaccaagcccctgcccgtgaccagcgtgagcatctacgactacaagcccagccccgagaccggcgtgctgttcgagatccactaccccgagaagtacaacgtgttcaccagagtgaacatcagctactgggagggcaaggacttcagaaccatgctgtacaaggacttcttcaagggcaagaccgtgttcaaccactggctgcccggcatgtgctacagcaacatcaccttccagctggtgagcgaggccaccttcaacaagagcaccctggtggagtacagcggcgtgagccacgagcccaagcagcacagaaccgccccctaccccccccagaacatcagcgtgagaatcgtgaacctgaacaagaacaactgggaggagcagagcggcaacttccccgaggagagcttcatgagaagccaggacaccatcggcaaggagaagctgttccacttcaccgaggagacccccgagatccccagcggcaacatcagcagcggctggcccgacttcaacagcagcgactacgagaccaccagccagccctactggtgggacagcgccagcgccgcccccgagagcgaggacgagttcgtgagcgtgctgcccatggagtacgagaacaacagcaccctgagcgagaccgagaagagcaccagcggcagcttcagcttcttccccgtgcagatgatcctgacctggctgccccccaagccccccaccgccttcgacggcttccacatccacatcgagagagaggagaacttcaccgagtacctgatggtggacgaggaggcccacgagttcgtggccgagctgaaggagcccggcaagtacaagctgagcgtgaccaccttcagcagcagcggcagctgcgagaccagaaagagccagagcgccaagagcctgagcttctacatcagccccagcggcgagtggatcgaggagctgaccgagaagccccagcacgtgagcgtgcacgtgctgagcagcaccaccgccctgatgagctggaccagcagccaggagaactacaacagcaccatcgtgagcgtggtgagcctgacctgccagaagcagaaggagagccagagactggagaagcagtactgcacccaggtgaacagcagcaagcccatcatcgagaacctggtgcccggcgcccagtaccaggtggtgatctacctgagaaagggccccctgatcggcccccccagcgaccccgtgaccttcgccatcgtgcccaccggcatcaaggacctgatgctgtaccccctgggccccaccgccgtggtgctgagctggaccagaccctacctgggcgtgttcagaaagtacgtggtggagatgttctacttcaaccccgccaccatgaccagcgagtggaccacctactacgagatcgccgccaccgtgagcctgaccgccagcgtgagaatcgccaacctgctgcccgcctggtactacaacttcagagtgaccatggtgacctggggcgaccccgagctgagctgctgcgacagcagcaccatcagcttcatcaccgcccccgtggcccccgagatcaccagcgtggagtacttcaacagcctgctgtacatcagctggacctacggcgacgacaccaccgacctgagccacagcagaatgctgcactggatggtggtggccgagggcaagaagaagatcaagaagagcgtgaccagaaacgtgatgaccgccatcctgagcctgccccccggcgacatctacaacctgagcgtgaccgcctgcaccgagagaggcagcaacaccagcatgctgagactggtgaagctggagcccgccccccccaagagcctgttcgccgtgaacaagacccagaccagcgtgaccctgctgtgggtggaggagggcgtggccgacttcttcgaggtgttctgccagcaggtgggcagcagccagaagaccaagctgcaggagcccgtggccgtgagcagccacgtggtgaccatcagcagcctgctgcccgccaccgcctacaactgcagcgtgaccagcttcagccacgacagccccagcgtgcccaccttcatcgccgtgagcaccatggtgaccgagatgaaccccaacgtggtggtgatcagcgtgctggccatcctgagcaccctgctgatcggcctgctgctggtgaccctgatcatcctgagaaagaagcacctgcagatggccagagagtgcggcgccggcaccttcgtgaacttcgccagcctggagagagacggcaagctgccctacaactggagcaagaacggcctgaagaagagaaagctgaccaaccccgtgcagctggacgacttcgacgcctacatcaaggacatggccaaggacagcgactacaagttcagcctgcagttcgaggagctgaagctgatcggcctggacatcccccacttcgccgccgacctgcccctgaacagatgcaagaacagatacaccaacatcctgccctacgacttcagcagagtgagactggtgagcatgaacgaggaggagggcgccgactacatcaacgccaactacatccccggctacaacagcccccaggagtacatcgccacccagggccccctgcccgagaccagaaacgacttctggaagatggtgctgcagcagaagagccagatcatcgtgatgctgacccagtgcaacgagaagagaagagtgaagtgcgaccactactggcccttcaccgaggagcccatcgcctacggcgacatcaccgtggagatgatcagcgaggaggagcaggacgactgggcctgcagacacttcagaatcaactacgccgacgagatgcaggacgtgatgcacttcaactacaccgcctggcccgaccacggcgtgcccaccgccaacgccgccgagagcatcctgcagttcgtgcacatggtgagacagcaggccaccaagagcaagggccccatgatcatccactgcagcgccggcgtgggcagaaccggcaccttcatcgccctggacagactgctgcagcacatcagagaccacgagttcgtggacatcctgggcctggtgagcgagatgagaagctacagaatgagcatggtgcagaccgaggagcagtacatcttcatccaccagtgcgtgcagctgatgtggatgaagaagaagcagcagttctgcatcagcgacgtgatctacgagaacgtgagcaagagctag

SEQ ID NO: 95578 - DNA, 1218 bp, Artificial Sequence
  Description of Artificial Sequence: Synthetic coding sequence
atggtgaccgagatgaaccccaacgtggtggtgatcagcgtgctggccatcctgagcaccctgctgatcggcctgctgctggtgaccctgatcatcctgagaaagaagcacctgcagatggccagagagtgcggcgccggcaccttcgtgaacttcgccagcctggagagagacggcaagctgccctacaactggagaagaagcatcttcgccttcctgaccctgctgcccagctgcctgtggaccgactacctgctggccttctacatcaacccctggagcaagaacggcctgaagaagagaaagctgaccaaccccgtgcagctggacgacttcgacgcctacatcaaggacatggccaaggacagcgactacaagttcagcctgcagttcgaggagctgaagctgatcggcctggacatcccccacttcgccgccgacctgcccctgaacagatgcaagaacagatacaccaacatcctgccctacgacttcagcagagtgagactggtgagcatgaacgaggaggagggcgccgactacatcaacgccaactacatccccggctacaacagcccccaggagtacatcgccacccagggccccctgcccgagaccagaaacgacttctggaagatggtgctgcagcagaagagccagatcatcgtgatgctgacccagtgcaacgagaagagaagagtgaagtgcgaccactactggcccttcaccgaggagcccatcgcctacggcgacatcaccgtggagatgatcagcgaggaggagcaggacgactgggcctgcagacacttcagaatcaactacgccgacgagatgcaggacgtgatgcacttcaactacaccgcctggcccgaccacggcgtgcccaccgccaacgccgccgagagcatcctgcagttcgtgcacatggtgagacagcaggccaccaagagcaagggccccatgatcatccactgcagcgccggcgtgggcagaaccggcaccttcatcgccctggacagactgctgcagcacatcagagaccacgagttcgtggacatcctgggcctggtgagcgagatgagaagctacagaatgagcatggtgcagaccgaggagcagtacatcttcatccaccagtgcgtgcagctgatgtggatgaagaagaagcagcagttctgcatcagcgacgtgatctacgagaacgtgagcaagagctag

SEQ ID NO: 95579 - DNA, 1218 bp, Artificial Sequence; identical to SEQ ID NO: 95578
  Description of Artificial Sequence: Synthetic coding sequence

SEQ ID NO: 95580 - DNA, 1134 bp, Artificial Sequence
  Description of Artificial Sequence: Synthetic coding sequence
atggtgaccgagatgaaccccaacgtggtggtgatcagcgtgctggccatcctgagcaccctgctgatcggcctgctgctggtgaccctgatcatcctgagaaagaagcacctgcagatggccagagagtgcggcgccggcaccttcgtgaacttcgccagcctggagagagacggcaagctgccctacaactggagcaagaacggcctgaagaagagaaagctgaccaaccccgtgcagctggacgacttcgacgcctacatcaaggacatggccaaggacagcgactacaagttcagcctgcagttcgaggagctgaagctgatcggcctggacatcccccacttcgccgccgacctgcccctgaacagatgcaagaacagatacaccaacatcctgccctacgacttcagcagagtgagactggtgagcatgaacgaggaggagggcgccgactacatcaacgccaactacatccccggctacaacagcccccaggagtacatcgccacccagggccccctgcccgagaccagaaacgacttctggaagatggtgctgcagcagaagagccagatcatcgtgatgctgacccagtgcaacgagaagagaagagtgaagtgcgaccactactggcccttcaccgaggagcccatcgcctacggcgacatcaccgtggagatgatcagcgaggaggagcaggacgactgggcctgcagacacttcagaatcaactacgccgacgagatgcaggacgtgatgcacttcaactacaccgcctggcccgaccacggcgtgcccaccgccaacgccgccgagagcatcctgcagttcgtgcacatggtgagacagcaggccaccaagagcaagggccccatgatcatccactgcagcgccggcgtgggcagaaccggcaccttcatcgccctggacagactgctgcagcacatcagagaccacgagttcgtggacatcctgggcctggtgagcgagatgagaagctacagaatgagcatggtgcagaccgaggagcagtacatcttcatccaccagtgcgtgcagctgatgtggatgaagaagaagcagcagttctgcatcagcgacgtgatctacgagaacgtgagcaagagctag

SEQ ID NO: 95581 - DNA, 1134 bp, Artificial Sequence; identical to SEQ ID NO: 95580
  Description of Artificial Sequence: Synthetic coding sequence

SEQ ID NO: 95582 - DNA, 6888 bp, Artificial Sequence
  Description of Artificial Sequence: Synthetic coding sequence
atggacttcctgatcatcttcctgctgctgttcatcggcaccagcgagacccaggtggacgtgagcaacgtggtgcccggcaccagatacgacatcaccatcagcagcatcagcaccacctacaccagccccgtgaccagaatcgtgaccaccaacgtgaccaagcccggcccccccgtgttcctggccggcgagagagtgggcagcgccggcatcctgctgagctggaacaccccccccaaccccaacggcagaatcatcagctacatcgtgaagtacaaggaggtgtgcccctggatgcagaccgtgtacacccaggtgagaagcaagcccgacagcctggaggtgctgctgaccaacctgaaccccggcaccacctacgagatcaaggtgatcatcctgaacgccaccaaggtgggctgcctgctgagccccatcctgctgaacaccgtgctggagggcctggccagagccatcaacctgaccagagagtgccagaccgtggacgccggccagtgcgtgcagtgcgccgtgagagagcccaagcagggcagcaccagcggcggcagagcccagaccaacaagaagaccgccgtgaccagcgccgacctgaaccacaccgccggcgacctgagaaccggcagactgcccccccagcccctgaccgccgagcagcccaactgggaggccccccccagcagaggcagactgaccccccacaaggccggctacagcagcgccaccgccgccggcacccaggccaacagagtgtggagcagacccctggccaagatccagaccaccatcagagagtactacaagcacctgtacgccaagaaggagggcatcctgcccaacagcttctacgaggccagcatcatcctgatccccaagcccgtgcccgagggccccccccagaactgcgtgaccggcaacatcaccggcaagagcttcagcatcctgtgggacccccccaccatcgtgaccggcaagttcagctacagagtggagctgtacggccccagcggcagaatcctggacaacagcaccaaggacctgaagttcgccttcaccaacctgacccccttcaccatgtacgacgtgtacatcgccgccgagaccagcgccggcaccggccccaagagcaacatcagcgtgttcaccccccccgacgtgcccggcgccgtgttcgacctgcagctggccgaggtggagagcacccaggtgagaatcacctggaagaagcccagacagcccaacggcatcatcaaccagtacagagtgaaggtgctggtgcccgagaccggcatcatcctggagaacaccctgctgaccggcaacaacgagtacatcaacgaccccatggcccccgagatcgtgaacatcgtggagcccatggtgggcctgtacgagggcagcgccgagatgagcagcgacctgcacagcctggccaccttcatctacaacagccaccccgacaagaacttccccgccagaaacagagccgaggaccagaccagccccgtggtgaccaccagaaaccagtacatcaccgacatcgccgccgagcagctgagctacgtgatcagaagactggtgcccttcaccgagcacatgatcagcgtgagcgccttcaccatcatgggcgagggcccccccaccgtgctgagcgtgagaaccagacagcaggtgcccagcagcatcaagatcatcaactacaagaacatcagcagcagcagcatcctgctgtactgggacccccccgagtaccccaacggcaagatcacccactacaccatctacgccatggagctggacaccaacagagccttccagatcaccaccatcgacaacagcttcctgatcaccggcctgaagaagtacaccaagtacaagatgagagtggccgccagcacccacgtgggcgagagcagcctgagcgaggagaacgacatcttcgtgagaaccagcgaggacgagcccgagagcagcccccaggacgtggaggtgatcgacgtgaccgccgacgagatcagactgaagtggagcccccccgagaagcccaacggcatcatcatcgcctacgaggtgctgtacaagaacatcgacaccctgtacatgaagaacaccagcaccaccgacatcatcctgagaaacctgagaccccacaccctgtacaacatcagcgtgagaagctacaccagattcggccacggcaaccaggtgagcagcctgctgagcgtgagaaccagcgagaccgtgcccgacagcgcccccgagaacatcacctacaagaacatcagcagcggcgagatcgagctgagcttcctgccccccagcagccccaacggcatcatccagaagtacaccatctacctgaagagaagcaacggcaacgaggagagaaccatcaacaccaccagcctgacccagaacatcaaggtgctgaagaagtacacccagtacatcatcgaggtgagcgccagcaccctgaagggcgagggcgtgagaagcgcccccatcagcatcctgaccgaggaggacgcccccgacagccccccccaggacttcagcgtgaagcagctgagcggcgtgaccgtgaagctgagctggcagccccccctggagcccaacggcatcatcctgtactacaccgtgtacgtgtggaacagaagcagcctgaagaccatcaacgtgaccgagaccagcctggagctgagcgacctggactacaacgtggagtacagcgcctacgtgaccgccagcaccagattcggcgacggcaagaccagaagcaacatcatcagcttccagacccccgagggcgcccccagcgacccccccaaggacgtgtactacgccaacctgagcagcagcagcatcatcctgttctggaccccccccagcaagcccaacggcatcatccagtactacagcgtgtactacagaaacaccagcggcaccttcatgcagaacttcaccctgcacgaggtgaccaacgacttcgacaacatgaccgtgagcaccatcatcgacaagctgaccatcttcagctactacaccttctggctgaccgccagcaccagcgtgggcaacggcaacaagagcagcgacatcatcgaggtgtacaccgaccaggacatccccgagggcttcgtgggcaacctgacctacgagagcatcagcagcaccgccatcaacgtgagctgggtgccccccgcccagcccaacggcctggtgttctactacgtgagcctgatcctgcagcagacccccagacacgtgagaccccccctggtgacctacgagagaagcatctacttcgacaacctggagaagtacaccgactacatcctgaagatcacccccagcaccgagaagggcttcagcgacacctacaccgcccagctgtacatcaagaccgaggaggacgtgcccgagaccagccccatcatcaacaccttcaagaacctgagcagcaccagcgtgctgctgagctgggacccccccgtgaagcccaacggcgccatcatcagctacgacctgaccctgcagggccccaacgagaactacagcttcatcaccagcgacaactacatcatcctggaggagctgagccccttcaccctgtacagcttcttcgccgccgccagaaccagaaagggcctgggccccagcagcatcctgttcttctacaccgacgagagcgtgcccctggcccccccccagaacctgaccctgatcaactgcaccagcgacttcgtgtggctgaagtggagccccagccccctgcccggcggcatcgtgaaggtgtacagcttcaagatccacgagcacgagaccgacaccatctactacaagaacatcagcggcttcaagaccgaggccaagctggtgggcctggagcccgtgagcacctacagcatcagagtgagcgccttcaccaaggtgggcaacggcaaccagttcagcaacgtggtgaagttcaccacccaggagagcgtgcccgacgtggtgcagaacatgcagtgcatggccaccagctggcagagcgtgctggtgaagtgggacccccccaagaaggccaacggcatcatcacccagtacatggtgaccgtggagagaaacagcaccaaggtgagcccccaggaccacatgtacaccttcatcaagctgctggccaacaccagctacgtgttcaaggtgagagccagcaccagcgccggcgagggcgacgagagcacctgccacgtgagcaccctgcccgagaccgtgcccagcgtgcccaccaacatcgccttcagcgacgtgcagagcaccagcgccaccctgacctggatcagacccgacaccatcctgggctacttccagaactacaagatcaccacccagctgagagcccagaagtgcaaggagtgggagagcgaggagtgcgtggagtaccagaagatccagtacctgtacgaggcccacctgaccgaggagaccgtgtacggcctgaagaagttcagatggtacagattccaggtggccgccagcaccaacgccggctacggcaacgccagcaactggatcagcaccaagaccctgcccggcccccccgacggcccccccgagaacgtgcacgtggtggccaccagccccttcagcatcagcatcagctggagcgagcccgccgtgatcaccggccccacctgctacctgatcgacgtgaagagcgtggacaacgacgagttcaacatcagcttcatcaagagcaacgaggagaacaagaccatcgagatcaaggacctggagatcttcaccagatacagcgtggtgatcaccgccttcaccggcaacatcagcgccgcctacgtggagggcaagagcagcgccgagatgatcgtgaccaccctggagagcgcccccaaggacccccccaacaacatgaccttccagaagatccccgacgaggtgaccaagttccagctgaccttcctgccccccagccagcccaacggcaacatccaggtgtaccaggccctggtgtacagagaggacgaccccaccgccgtgcagatccacaacctgagcatcatccagaagaccaacaccttcgtgatcgccatgctggagggcctgaagggcggccacacctacaacatcagcgtgtacgccgtgaacagcgccggcgccggccccaaggtgcccatgagaatcaccatggacatcaaggcccccgccagacccaagaccaagcccacccccatctacgacgccaccggcaagctgctggtgaccagcaccaccatcaccatcagaatgcccatctgctactacagcgacgaccacggccccatcaagaacgtgcaggtgctggtgaccgagaccggcgcccagcacgacggcaacgtgaccaagtggtacgacgcctacttcaacaaggccagaccctacttcaccaacgagggcttccccaaccccccctgcaccgagggcaagaccaagttcagcggcaacgaggagatctacatcatcggcgccgacaacgcctgcatgatccccggcaacgaggacaagatctgcaacggccccctgaagcccaagaagcagtacctgttcaagttcagagccaccaacatcatgggccagttcaccgacagcgactacagcgaccccgtgaagaccctgggcgagggcctgagcgagagaaccgtggagatcatcctgagcgtgaccctgtgcatcctgagcatcatcctgctgggcaccgccatcttcgccttcgccagaatcagacagaagcagaaggagggcggcacctacagcccccaggacgccgagatcatcgacaccaagctgaagctggaccagctgatcaccgtggccgacctggagctgaaggacgagagactgaccagactgctgagctacagaaagagcatcaagcccatcagcaagaagagcttcctgcagcacgtggaggagctgtgcaccaacaacaacctgaagttccaggaggagttcagcgagctgcccaagttcctgcaggacctgagcagcaccgacgccgacctgccctggaacagagccaagaacagattccccaacatcaagccctacaacaacaacagagtgaagctgatcgccgacgccagcgtgcccggcagcgactacatcaacgccagctacatcagcggctacctgtgccccaacgagttcatcgccacccagggccccctgcccggcaccgtgggcgacttctggagaatggtgtgggagaccagagccaagaccctggtgatgctgacccagtgcttcgagaagggcagaatcagatgccaccagtactggcccgaggacaacaagcccgtgaccgtgttcggcgacatcgtgatcaccaagctgatggaggacgtgcagatcgactggaccatcagagacctgaagatcgagagacacggcgactgcatgaccgtgagacagtgcaacttcaccgcctggcccgagcacggcgtgcccgagaacagcgcccccctgatccacttcgtgaagctggtgagagccagcagagcccacgacaccacccccatgatcgtgcactgcagcgccggcgtgggcagaaccggcgtgttcatcgccctggaccacctgacccagcacatcaacgaccacgacttcgtggacatctacggcctggtggccgagctgagaagcgagagaatgtgcatggtgcagaacctggcccagtacatcttcctgcaccagtgcatcctggacctgctgagcaacaagggcagcaaccagcccatctgcttcgtgaactacagcgccctgcagaagatggacagcctggacgccatggagggcgacgtggagctggagtgggaggagaccaccatgtag

SEQ ID NO: 95583 - DNA, 5787 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcgaccaggccttcagccacctgcccaccggcgccctgcagatcgagagcagcgaggagaccgaccagggcaagtacgagtgcgtggccaccaacagcgccggcgtgagatacagcagccccgccaacctgtacgtgagagtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccagtgggagaccgacgacaccgccgagtacgagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccggcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95584 - DNA, 5733 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcggcgccctgcagatcgagagcagcgaggagaccgaccagggcaagtacgagtgcgtggccaccaacagcgccggcgtgagatacagcagccccgccaacctgtacgtgagagtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccaggagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccggcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95585 - DNA, 4506 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcggcgccctgcagatcgagagcagcgaggagaccgaccagggcaagtacgagtgcgtggccaccaacagcgccggcgtgagatacagcagccccgccaacctgtacgtgagagtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcatcagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccggcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95586 - DNA, 5847 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcgaccaggccttcagccacctgcccaccggcgccctgcagatcgagagcagcgaggagaccgaccagggcaagtacgagtgcgtggccaccaacagcgccggcgtgagatacagcagccccgccaacctgtacgtgagagtgtggagaaccgtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccagtgggagaccgacgacaccgccgagtacgagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95587 - DNA, 4593 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcgaccaggccttcagccacctgcccaccggcgccctgcagatcgagagcagcgaggagaccgaccagggcaagtacgagtgcgtggccaccaacagcgccggcgtgagatacagcagccccgccaacctgtacgtgagagtgtggagaaccgtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcatcagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95588 - DNA, 5820 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcgaccaggccttcagccacctgcccaccggcgccctgcagatcgagagcagcgaggagaccgaccagggcaagtacgagtgcgtggccaccaacagcgccggcgtgagatacagcagccccgccaacctgtacgtgagagtgtggagaaccgtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccaggagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95589 - DNA, 5847 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcgagaccttcgagagcacccccatcagaggcgccctgcagatcgagagcagcgaggagaccgaccagggcaagtacgagtgcgtggccaccaacagcgccggcgtgagatacagcagccccgccaacctgtacgtgagagagctgagagaggtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccagtgggagaccgacgacaccgccgagtacgagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95590 - DNA, 5850 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagaagcgagaccttcgagagcacccccatcagaggcgccctgcagatcgagagcagcgaggagaccgaccagggcaagtacgagtgcgtggccaccaacagcgccggcgtgagatacagcagccccgccaacctgtacgtgagagagctgagagaggtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcaagcccagcgcccccccccaggacgtgaagtgcgtgagcgtgagaagcaccgccatcctggtgagctggagaccccccccccccgagacccacaacggcgccctggtgggctacagcgtgagatacagacccctgggcagcgaggaccccgagcccaaggaggtgaacggcatcccccccaccaccacccagatcctgctggaggccctggagaagtggacccagtacagaatcaccaccgtggcccacaccgaggtgggccccggccccgagagcagccccgtggtggtgagaaccgacgaggacgtgcccagcgccccccccagaaaggtggaggccgaggccctgaacgccaccgccatcagagtgctgtggagaagccccgcccccggcagacagcacggccagatcagaggctaccaggtgcactacgtgagaatggagggcgccgaggccagaggcccccccagaatcaaggacgtgatgctggccgacgcccagtgggagaccgacgacaccgccgagtacgagatggtgatcaccaacctgcagcccgagaccgcctacagcatcaccgtggccgcctacaccatgaagggcgacggcgccagaagcaagcccaaggtggtggtgaccaagggcgccgtgctgggcagacccaccctgagcgtgcagcagacccccgagggcagcctgctggccagatgggagccccccgccggcaccgccgaggaccaggtgctgggctacagactgcagttcggcagagaggacagcacccccctggccaccctggagttcccccccagcgaggacagatacaccgccagcggcgtgcacaagggcgccacctacgtgttcagactggccgccagaagcagaggcggcctgggcgaggaggccgccgaggtgctgagcatccccgaggacacccccagaggccacccccagatcctggaggccgccggcaacgccagcgccggcaccgtgctgctgagatggctgccccccgtgcccgccgagagaaacggcgccatcgtgaagtacaccgtggccgtgagagaggccggcgccctgggccccgccagagagaccgagctgcccgccgccgccgagcccggcgccgagaacgccctgaccctgcagggcctgaagcccgacaccgcctacgacctgcaggtgagagcccacaccagaagaggccccggccccttcagcccccccgtgagatacagaaccttcctgagagaccaggtgagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaagaagccccacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95591 - DNA, 4683 bp, Artificial Sequence
  Description of Artificial Sequence: Synthetic coding sequence
agaagcgccagaggcctgagcgtgagagacagaggcgccatccccctgcagggcggcgacagaagaagcctgcccagcatggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcggcgccctgcagatcgagagcagcgaggagaccgaccagggcaagtacgagtgcgtggccaccaacagcgccggcgtgagatacagcagccccgccaacctgtacgtgagagtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcatcagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccgacagcggcctgagaagccccctgagagagcccggcttccacttcgagagcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgagaccgagagcagacccggctggagcgccgtggcccagagcagactgaccgccagcagcgccagctggatccacgccatcctgctgccccagccccccgagtggctgggcctgcaggtgtag

SEQ ID NO: 95592 - DNA, 4518 bp, Artificial Sequence
  Description of Artificial Sequence: Synthetic coding sequence
atggcccccacctggggccccggcatggtgagcgtggtgggccccatgggcctgctggtggtgctgctggtgggcggctgcgccgccgaggagccccccagattcatcaaggagcccaaggaccagatcggcgtgagcggcggcgtggccagcttcgtgtgccaggccaccggcgaccccaagcccagagtgacctggaacaagaagggcaagaaggtgaacagccagagattcgagaccatcgagttcgacgagagcgccggcgccgtgctgagaatccagcccctgagaacccccagagacgagaacgtgtacgagtgcgtggcccagaacagcgtgggcgagatcaccgtgcacgccaagctgaccgtgctgagagaggaccagctgcccagcggcttccccaacatcgacatgggcccccagctgaaggtggtggagagaaccagaaccgccaccatgctgtgcgccgccagcggcaaccccgaccccgagatcacctggttcaaggacttcctgcccgtggaccccagcgccagcaacggcagaatcaagcagctgagaagcggcgccctgcagatcgagagcagcgaggagaccgaccagggcaagtacgagtgcgtggccaccaacagcgccggcgtgagatacagcagccccgccaacctgtacgtgagagccctgagagaggtgagaagagtggcccccagattcagcatcctgcccatgagccacgagatcatgcccggcggcaacgtgaacatcacctgcgtggccgtgggcagccccatgccctacgtgaagtggatgcagggcgccgaggacctgacccccgaggacgacatgcccgtgggcagaaacgtgctggagctgaccgacgtgaaggacagcgccaactacacctgcgtggccatgagcagcctgggcgtgatcgaggccgtggcccagatcaccgtgaagagcctgcccaaggcccccggcacccccatggtgaccgagaacaccgccaccagcatcaccatcacctgggacagcggcaaccccgaccccgtgagctactacgtgatcgagtacaagagcaagagccaggacggcccctaccagatcaaggaggacatcaccaccaccagatacagcatcggcggcctgagccccaacagcgagtacgagatctgggtgagcgccgtgaacagcatcggccagggcccccccagcgagagcgtggtgaccagaaccggcgagcaggcccccgccagcgcccccagaaacgtgcaggccagaatgctgagcgccaccaccatgatcgtgcagtgggaggagcccgtggagcccaacggcctgatcagaggctacagagtgtactacaccatggagcccgagcaccccgtgggcaactggcagaagcacaacgtggacgacagcctgctgaccaccgtgggcagcctgctggaggacgagacctacaccgtgagagtgctggccttcaccagcgtgggcgacggccccctgagcgaccccatccaggtgaagacccagcagggcgtgcccggccagcccatgaacctgagagccgaggccagaagcgagaccagcatcaccctgagctggagcccccccagacaggagagcatcatcaagtacgagctgctgttcagagagggcgaccacggcagagaggtgggcagaaccttcgaccccaccaccagctacgtggtggaggacctgaagcccaacaccgagtacgccttcagactggccgccagaagcccccagggcctgggcgccttcacccccgtggtgagacagagaaccctgcagagcatcagccccaagaacttcaaggtgaagatgatcatgaagaccagcgtgctgctgagctgggagttccccgacaactacaacagccccaccccctacaagatccagtacaacggcctgaccctggacgtggacggcagaaccaccaagaagctgatcacccacctgaagccccacaccttctacaacttcgtgctgaccaacagaggcagcagcctgggcggcctgcagcagaccgtgaccgcctggaccgccttcaacctgctgaacggcaagcccagcgtggcccccaagcccgacgccgacggcttcatcatggtgtacctgcccgacggccagagccccgtgcccgtgcagagctacttcatcgtgatggtgcccctgagaaagagcagaggcggccagttcctgacccccctgggcagccccgaggacatggacctggaggagctgatccaggacatcagcagactgcagagaagaagcctgagacacagcagacagctggaggtgcccagaccctacatcgccgccagattcagcgtgctgccccccaccttccaccccggcgaccagaagcagtacggcggcttcgacaacagaggcctggagcccggccacagatacgtgctgttcgtgctggccgtgctgcagaagagcgagcccaccttcgccgccagccccttcagcgaccccttccagctggacaaccccgacccccagcccatcgtggacggcgaggagggcctgatctgggtgatcggccccgtgctggccgtggtgttcatcatctgcatcgtgatcgccatcctgctgtacaagaacaagcccgacagcaagagaaaggacagcgagcccagaaccaagtgcctgctgaacaacgccgacctggccccccaccaccccaaggaccccgtggagatgagaagaatcaacttccagacccccggcatgctgagccacccccccatccccatcgccgacatggccgagcacaccgagagactgaaggccaacgacagcctgaagctgagccaggagtacgagagcatcgaccccggccagcagttcacctgggagcacagcaacctggaggtgaacaagcccaagaacagatacgccaacgtgatcgcctacgaccacagcagagtgatcctgcagcccatcgagggcatcatgggcagcgactacatcaacgccaactacgtggacggctacagatgccagaacgcctacatcgccacccagggccccctgcccgagaccttcggcgacttctggagaatggtgtgggagcagagaagcgccaccatcgtgatgatgaccagactggaggagaagagcagaatcaagtgcgaccagtactggcccaacagaggcaccgagacctacggcttcatccaggtgaccctgctggacaccatcgagctggccaccttctgcgtgagaaccttcagcctgcacaagaacggcagcagcgagaagagagaggtgagacagttccagttcaccgcctggcccgaccacggcgtgcccgagtaccccacccccttcctggccttcctgagaagagtgaagacctgcaacccccccgacgccggccccatcgtggtgcactgcagcgccggcgtgggcagaaccggctgcttcatcgtgatcgacgccatgctggagagaatcaagcccgagaagaccgtggacgtgtacggccacgtgaccctgatgagaagccagagaaactacatggtgcagaccgaggaccagtacagcttcatccacgaggccctgctggaggccgtgggctgcggcaacaccgaggtgcccgccagaagcctgtacgcctacatccagaagctggcccaggtggagcccggcgagcacgtgaccggcatggagctggagttcaagagactggccaacagcaaggcccacaccagcagattcatcagcgccaacctgccctgcaacaagttcaagaacagactggtgaacatcatgccctacgagagcaccagagtgtgcctgcagcccatcagaggcgtggagggcagcgactacatcaacgccagcttcatcgacggctacagacagcagaaggcctacatcgccacccagggccccctggccgagaccaccgaggacttctggagaatgctgtgggagaacaacagcaccatcgtggtgatgctgaccaagctgagagagatgggcagagagaagtgccaccagtactggcccgccgagagaagcgccagataccagtacttcgtggtggaccccatggccgagtacaacatgccccagtacatcctgagagagttcaaggtgaccgacgccagagacggccagagcagaaccgtgagacagttccagttcaccgactggcccgagcagggcgtgcccaagagcggcgagggcttcatcgacttcatcggccaggtgcacaagaccaaggagcagttcggccaggacggccccatcagcgtgcactgcagcgccggcgtgggcagaaccggcgtgttcatcaccctgagcatcgtgctggagagaatgagatacgagggcgtggtggacatcttccagaccgtgaagatgctgagaacccagagacccgccatggtgcagaccgaggacgagtaccagttctgctaccaggccgccctggagtacctgggcagcttcgaccactacgccacctag

SEQ ID NO: 95593 - DNA, 4329 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacctgagaggcggcagaaccggctaccacagaagcaaccacttcatcgccacccagggccccaagcccgagatggtgtacgacttctggagaatggtgtggcaggagcactgcagcagcatcgtgatgatcaccaagctggtggaggtgggcagagtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagactgcaggagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95594 - DNA, 4341 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcagagaccactacgcctacagctactaccccaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacggctaccacagaagcaaccacttcatcgccacccagggccccaagcccgagatggtgtacgacttctggagaatggtgtggcaggagcactgcagcagcatcgtgatgatcaccaagctggtggaggtgggcagagtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagactgcaggagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95595 - DNA, 4329 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacatcagaatcaacagagagggctaccacagaagcaaccacttcatcgccacccagggccccaagcccgagatggtgtacgacttctggagaatggtgtggcaggagcactgcagcagcatcgtgatgatcaccaagctggtggaggtgggcagagtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagactgcaggagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95596 - DNA, 4311 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacggctaccacagaagcaaccacttcatcgccacccagggccccaagcccgagatggtgtacgacttctggagaatggtgtggcaggagcactgcagcagcatcgtgatgatcaccaagctggtggaggtgggcagagtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagactgcaggagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95597 - DNA, 4302 bp, Artificial Sequence
  Description of Artificial Sequence: Synthetic coding sequence
atggccagagcccaggccctggtgctggccctgaccttccagctgtgcgcccccgagaccgagacccccgccgccggctgcaccttcgaggaggccagcgaccccgccgtgccctgcgagtacagccaggcccagtacgacgacttccagtgggagcaggtgagaatccaccccggcaccagagcccccgccgacctgccccacggcagctacctgatggtgaacaccagccagcacgcccccggccagagagcccacgtgatcttccagagcctgagcgagaacgacacccactgcgtgcagttcagctacttcctgtacagcagagacggccacagccccggcaccctgggcgtgtacgtgagagtgaacggcggccccctgggcagcgccgtgtggaacatgaccggcagccacggcagacagtggcaccaggccgagctggccgtgagcaccttctggcccaacgagtaccaggtgctgttcgaggccctgatcagccccgacagaagaggctacatgggcctggacgacatcctgctgctgagctacccctgcgccaaggccccccacttcagcagactgggcgacgtggaggtgaacgccggccagaacgccagcttccagtgcatggccgccggcagagccgccgaggccgagagattcctgctgcagagacagagcggcgccctggtgcccgccgccggcgtgagacacatcagccacagaagattcctggccaccttccccctggccgccgtgagcagagccgagcaggacctgtacagatgcgtgagccaggcccccagaggcgccggcgtgagcaacttcgccgagctgatcgtgaaggagccccccacccccatcgcccccccccagctgctgagagccggccccacctacctgatcatccagctgaacaccaacagcatcatcggcgacggccccatcgtgagaaaggagatcgagtacagaatggccagaggcccctgggccgaggtgcacgccgtgagcctgcagacctacaagctgtggcacctggaccccgacaccgagtacgagatcagcgtgctgctgaccagacccggcgacggcggcaccggcagacccggcccccccctgatcagcagaaccaagtgcgccgagcccatgagagcccccaagggcctggccttcgccgagatccaggccagacagctgaccctgcagtgggagcccctgggctacaacgtgaccagatgccacacctacaccgtgagcctgtgctaccactacaccctgggcagcagccacaaccagaccatcagagagtgcgtgaagaccgagcagggcgtgagcagatacaccatcaagaacctgctgccctacagaaacgtgcacgtgagactggtgctgaccaaccccgagggcagaaaggagggcaaggaggtgaccttccagaccgacgaggacgtgcccagcggcatcgccgccgagagcctgaccttcacccccctggaggacatgatcttcctgaagtgggaggagccccaggagcccaacggcctgatcacccagtacgagatcagctaccagagcatcgagagcagcgaccccgccgtgaacgtgcccggccccagaagaaccatcagcaagctgagaaacgagacctaccacgtgttcagcaacctgcaccccggcaccacctacctgttcagcgtgagagccagaaccggcaagggcttcggccaggccgccctgaccgagatcaccaccaacatcagcgcccccagcttcgactacgccgacatgcccagccccctgggcgagagcgagaacaccatcaccgtgctgctgagacccgcccagggcagaggcgcccccatcagcgtgtaccaggtgatcgtggaggaggagagagccagaagactgagaagagagcccggcggccaggactgcttccccgtgcccctgaccttcgaggccgccctggccagaggcctggtgcactacttcggcgccgagctggccgccagcagcctgcccgaggccatgcccttcaccgtgggcgacaaccagacctacagaggcttctggaacccccccctggagcccagaaaggcctacctgatctacttccaggccgccagccacctgaagggcgagaccagactgaactgcatcagaatcgccagaaaggccgcctgcaaggagagcaagagacccctggaggtgagccagagaagcgaggagatgggcctgatcctgggcatctgcgccggcggcctggccgtgctgatcctgctgctgggcgccatcatcgtgatcatcagaaagggcaagcccgtgaacatgaccaaggccaccgtgaactacagacaggagaagacccacatgatgagcgccgtggacagaagcttcaccgaccagagcaccctgcaggaggacgagagactgggcctgagcttcatggacacccacggctacagcaccagaggcgaccagagaagcggcggcgtgaccgaggccagcagcctgctgggcggcagccccagaagaccctgcggcagaaagggcagcccctaccacaccggccagctgcaccccgccgtgagagtggccgacctgctgcagcacatcaaccagatgaagaccgccgagggctacggcttcaagcaggagtacgagagcttcttcgagggctgggacgccaccaagaagaaggacaaggtgaagggcagcagacaggagcccatgcccgcctacgacagacacagagtgaagctgcaccccatgctgggcgaccccaacgccgactacatcaacgccaactacatcgacggctaccacagaagcaaccacttcatcgccacccagggccccaagcccgagatggtgtacgacttctggagaatggtgtggcaggagcactgcagcagcatcgtgatgatcaccaagctggtggaggtgaagtgcagcagatactggcccgaggacagcgacacctacggcgacatcaagatcatgctggtgaagaccgagaccctggccgagtacgtggtgagaaccttcgccctggagagaagaggctacagcgccagacacgaggtgagacagttccacttcaccgcctggcccgagcacggcgtgccctaccacgccaccggcctgctggccttcatcagaagagtgaaggccagcaccccccccgacgccggccccatcgtgatccactgcagcgccggcaccggcagaaccggctgctacatcgtgctggacgtgatgctggacatggccgagtgcgagggcgtggtggacatctacaactgcgtgaagaccctgtgcagcagaagagtgaacatgatccagaccgaggagcagtacatcttcatccacgacgccatcctggaggcctgcctgtgcggcgagaccaccatccccgtgagcgagttcaaggccacctacaaggagatgatcagaatcgacccccagagcaacagcagccagctgagagaggagttccagaccctgaacagcgtgaccccccccctggacgtggaggagtgcagcatcgccctgctgcccagaaacagagacaagaacagaagcatggacgtgctgccccccgacagatgcctgcccttcctgatcagcaccgacggcgacagcaacaactacatcaacgccgccctgaccgacagctacaccagaagcgccgccttcatcgtgaccctgcaccccctgcagagcaccacccccgacttctggagactggtgtacgactacggctgcaccagcatcgtgatgctgaaccagctgaaccagagcaacagcgcctggccctgcctgcagtactggcccgagcccggcagacagcagtacggcctgatggaggtggagttcatgagcggcaccgccgacgaggacctggtggccagagtgttcagagtgcagaacatcagcagactgcaggagggccacctgctggtgagacacttccagttcctgagatggagcgcctacagagacacccccgacagcaagaaggccttcctgcacctgctggccgaggtggacaagtggcaggccgagagcggcgacggcagaaccatcgtgcactgcctgaacggcggcggcagaagcggcaccttctgcgcctgcgccaccgtgctggagatgatcagatgccacaacctggtggacgtgttcttcgccgccaagaccctgagaaactacaagcccaacatggtggagaccatggaccagtaccacttctgctacgacgtggccctggagtacctggagggcctggagagcagatag

SEQ ID NO: 95598 - DNA, 6948 bp, Artificial Sequence
  Description of Artificial Sequence: Synthetic coding sequence
atgagaatcctgaagagattcctggcctgcatccagctgctgtgcgtgtgcagactggactgggccaacggctactacagacagcagagaaagctggtggaggagatcggctggagctacaccggcgccctgaaccagaagaactggggcaagaagtaccccacctgcaacagccccaagcagagccccatcaacatcgacgaggacctgacccaggtgaacgtgaacctgaagaagctgaagttccagggctgggacaagaccagcctggagaacaccttcatccacaacaccggcaagaccgtggagatcaacctgaccaacgactacagagtgagcggcggcgtgagcgagatggtgttcaaggccagcaagatcaccttccactggggcaagtgcaacatgagcagcgacggcagcgagcacagcctggagggccagaagttccccctggagatgcagatctactgcttcgacgccgacagattcagcagcttcgaggaggccgtgaagggcaagggcaagctgagagccctgagcatcctgttcgaggtgggcaccgaggagaacctggacttcaaggccatcatcgacggcgtggagagcgtgagcagattcggcaagcaggccgccctggaccccttcatcctgctgaacctgctgcccaacagcaccgacaagtactacatctacaacggcagcctgaccagccccccctgcaccgacaccgtggactggatcgtgttcaaggacaccgtgagcatcagcgagagccagctggccgtgttctgcgaggtgctgaccatgcagcagagcggctacgtgatgctgatggactacctgcagaacaacttcagagagcagcagtacaagttcagcagacaggtgttcagcagctacaccggcaaggaggagatccacgaggccgtgtgcagcagcgagcccgagaacgtgcaggccgaccccgagaactacaccagcctgctggtgacctgggagagacccagagtggtgtacgacaccatgatcgagaagttcgccgtgctgtaccagcagctggacggcgaggaccagaccaagcacgagttcctgaccgacggctaccaggacctgggcgccatcctgaacaacctgctgcccaacatgagctacgtgctgcagatcgtggccatctgcaccaacggcctgtacggcaagtacagcgaccagctgatcgtggacatgcccaccgacaaccccgagctggacctgttccccgagctgatcggcaccgaggagatcatcaaggaggaggaggagggcaaggacatcgaggagggcgccatcgtgaaccccggcagagacagcgccaccaaccagatcagaaagaaggagccccagatcagcaccaccacccactacaacagaatcggcaccaagtacaacgaggccaagaccaacagaagccccaccagaggcagcgagttcagcggcaagggcgacgtgcccaacaccagcctgaacagcaccagccagcccgtgaccaagctggccaccgagaaggacatcagcctgaccagccagaccgtgaccgagctgcccccccacaccgtggagggcaccagcgccagcctgaacgacggcagcaagaccgtgctgagaagcccccacatgaacctgagcggcaccgccgagagcctgaacaccgtgagcatcaccgagtacgaggaggagagcctgctgaccagcttcaagctggacaccggcgccgaggacagcagcggcagcagccccgccaccagcgccatccccttcatcagcgagaacatcagccagggctacatcttcagcagcgagaaccccgagaccatcacctacgacgtgctgatccccgagagcgccagaaacgccagcgaggacagcaccagcagcggcagcgaggagagcctgaaggaccccagcatggagggcaacgtgtggttccccagcagcaccgacatcaccgcccagcccgacgtgggcagcggcagagagagcttcctgcagaccaactacaccgagatcagagtggacgagagcgagaagaccaccaagagcttcagcgccggccccgtgatgagccagggccccagcgtgaccgacctggagatgccccactacagcaccttcgcctacttccccaccgaggtgaccccccacgccttcacccccagcagcagacagcaggacctggtgagcaccgtgaacgtggtgtacagccagaccacccagcccgtgtacaacggcgagacccccctgcagcccagctacagcagcgaggtgttccccctggtgacccccctgctgctggacaaccagatcctgaacaccacccccgccgccagcagcagcgacagcgccctgcacgccacccccgtgttccccagcgtggacgtgagcttcgagagcatcctgagcagctacgacggcgcccccctgctgcccttcagcagcgccagcttcagcagcgagctgttcagacacctgcacaccgtgagccagatcctgccccaggtgaccagcgccaccgagagcgacaaggtgcccctgcacgccagcctgcccgtggccggcggcgacctgctgctggagcccagcctggcccagtacagcgacgtgctgagcaccacccacgccgccagcgagaccctggagttcggcagcgagagcggcgtgctgtacaagaccctgatgttcagccaggtggagccccccagcagcgacgccatgatgcacgccagaagcagcggccccgagcccagctacgccctgagcgacaacgagggcagccagcacatcttcaccgtgagctacagcagcgccatccccgtgcacgacagcgtgggcgtgacctaccagggcagcctgttcagcggccccagccacatccccatccccaagagcagcctgatcacccccaccgccagcctgctgcagcccacccacgccctgagcggcgacggcgagtggagcggcgccagcagcgacagcgagttcctgctgcccgacaccgacggcctgaccgccctgaacatcagcagccccgtgagcgtggccgagttcacctacaccaccagcgtgttcggcgacgacaacaaggccctgagcaagagcgagatcatctacggcaacgagaccgagctgcagatccccagcttcaacgagatggtgtaccccagcgagagcaccgtgatgcccaacatgtacgacaacgtgaacaagctgaacgccagcctgcaggagaccagcgtgagcatcagcagcaccaagggcatgttccccggcagcctggcccacaccaccaccaaggtgttcgaccacgagatcagccaggtgcccgagaacaacttcagcgtgcagcccacccacaccgtgagccaggccagcggcgacaccagcctgaagcccgtgctgagcgccaacagcgagcccgccagcagcgaccccgccagcagcgagatgctgagccccagcacccagctgctgttctacgagaccagcgccagcttcagcaccgaggtgctgctgcagcccagcttccaggccagcgacgtggacaccctgctgaagaccgtgctgcccgccgtgcccagcgaccccatcctggtggagacccccaaggtggacaagatcagcagcaccatgctgcacctgatcgtgagcaacagcgccagcagcgagaacatgctgcacagcaccagcgtgcccgtgttcgacgtgagccccaccagccacatgcacagcgccagcctgcagggcctgaccatcagctacgccagcgagaagtacgagcccgtgctgctgaagagcgagagcagccaccaggtggtgcccagcctgtacagcaacgacgagctgttccagaccgccaacctggagatcaaccaggcccacccccccaagggcagacacgtgttcgccacccccgtgctgagcatcgacgagcccctgaacaccctgatcaacaagctgatccacagcgacgagatcctgaccagcaccaagagcagcgtgaccggcaaggtgttcgccggcatccccaccgtggccagcgacaccttcgtgagcaccgaccacagcgtgcccatcggcaacggccacgtggccatcaccgccgtgagcccccacagagacggcagcgtgaccagcaccaagctgctgttccccagcaaggccaccagcgagctgagccacagcgccaagagcgacgccggcctggtgggcggcggcgaggacggcgacaccgacgacgacggcgacgacgacgacgacgacagaggcagcgacggcctgagcatccacaagtgcatgagctgcagcagctacagagagagccaggagaaggtgatgaacgacagcgacacccacgagaacagcctgatggaccagaacaaccccatcagctacagcctgagcgagaacagcgaggaggacaacagagtgaccagcgtgagcagcgacagccagaccggcatggacagaagccccggcaagagccccagcgccaacggcctgagccagaagcacaacgacggcaaggaggagaacgacatccagaccggcagcgccctgctgcccctgagccccgagagcaaggcctgggccgtgctgaccagcgacgaggagagcggcagcggccagggcaccagcgacagcctgaacgagaacgagaccagcaccgacttcagcttcgccgacaccaacgagaaggacgccgacggcatcctggccgccggcgacagcgagatcacccccggcttcccccagagccccaccagcagcgtgaccagcgagaacagcgaggtgttccacgtgagcgaggccgaggccagcaacagcagccacgagagcagaatcggcctggccgagggcctggagagcgagaagaaggccgtgatccccctggtgatcgtgagcgccctgaccttcatctgcctggtggtgctggtgggcatcctgatctactggagaaagtgcttccagaccgcccacttctacctggaggacagcaccagccccagagtgatcagcaccccccccacccccatcttccccatcagcgacgacgtgggcgccatccccatcaagcacttccccaagcacgtggccgacctgcacgccagcagcggcttcaccgaggagttcgagaccctgaaggagttctaccaggaggtgcagagctgcaccgtggacctgggcatcaccgccgacagcagcaaccaccccgacaacaagcacaagaacagatacatcaacatcgtggcctacgaccacagcagagtgaagctggcccagctggccgagaaggacggcaagctgaccgactacatcaacgccaactacgtggacggctacaacagacccaaggcctacatcgccgcccagggccccctgaagagcaccgccgaggacttctggagaatgatctgggagcacaacgtggaggtgatcgtgatgatcaccaacctggtggagaagggcagaagaaagtgcgaccagtactggcccgccgacggcagcgaggagtacggcaacttcctggtgacccagaagagcgtgcaggtgctggcctactacaccgtgagaaacttcaccctgagaaacaccaagatcaagaagggcagccagaagggcagacccagcggcagagtggtgacccagtaccactacacccagtggcccgacatgggcgtgcccgagtacagcctgcccgtgctgaccttcgtgagaaaggccgcctacgccaagagacacgccgtgggccccgtggtggtgcactgcagcgccggcgtgggcagaaccggcacctacatcgtgctggacagcatgctgcagcagatccagcacgagggcaccgtgaacatcttcggcttcctgaagcacatcagaagccagagaaactacctggtgcagaccgaggagcagtacgtgttcatccacgacaccctggtggaggccatcctgagcaaggagaccgaggtgctggacagccacatccacgcctacgtgaacgccctgctgatccccggccccgccggcaagaccaagctggagaagcagttccagctgctgagccagagcaacatccagcagagcgactacagcgccgccctgaagcagtgcaacagagagaagaacagaaccagcagcatcatccccgtggagagaagcagagtgggcatcagcagcctgagcggcgagggcaccgactacatcaacgccagctacatcatgggctactaccagagcaacgagttcatcatcacccagcaccccctgctgcacaccatcaaggacttctggagaatgatctgggaccacaacgcccagctggtggtgatgatccccgacggccagaacatggccgaggacgagttcgtgtactggcccaacaaggacgagcccatcaactgcgagagcttcaaggtgaccctgatggccgaggagcacaagtgcctgagcaacgaggagaagctgatcatccaggacttcatcctggaggccacccaggacgactacgtgctggaggtgagacacttccagtgccccaagtggcccaaccccgacagccccatcagcaagaccttcgagctgatcagcgtgatcaaggaggaggccgccaacagagacggccccatgatcgtgcacgacgagcacggcggcgtgaccgccggcaccttctgcgccctgaccaccctgatgcaccagctggagaaggagaacagcgtggacgtgtaccaggtggccaagatgatcaacctgatgagacccggcgtgttcgccgacatcgagcagtaccagttcctgtacaaggtgatcctgagcctggtgagcaccagacaggaggagaaccccagcaccagcctggacagcaacggcgccgccctgcccgacggcaacatcgccgagagcctggagagcctggtgtag

SEQ ID NO: 95599 - DNA, 474 bp, Artificial Sequence
  Description of Artificial Sequence: Synthetic coding sequence
atgggcagactgaccgaggccgccgccgccggcagcggcagcagagccgccggctgggccggcagcccccccaccctgctgcccctgagccccaccagccccagatgcgccgccaccatggccagcagcgacgaggacggcaccaacggcggcgccagcgaggccggcgaggacagagaggcccccggcgagagaagaagactgggcgtgctggccaccgcctggctgaccttctacgacatcgccatgaccgccggcagactgatcctgagccccagactggagtgcatcggcgccatcagcgcccactgccagccccagccccccgagttcaagagattcagctgcctgggcctgagaagcagctgggactacaagagaggcccccccagacccatcaacttctgcatcttcggcagagacagagtgagcccctgctggcccggctggagcagaacccccgacctgaagtag

SEQ ID NO: 95600 - DNA, 867 bp, Artificial Sequence
  Description of Artificial Sequence: Synthetic coding sequence
atgggcagactgaccgaggccgccgccgccggcagcggcagcagagccgccggctgggccggcagcccccccaccctgctgcccctgagccccaccagccccagatgcgccgccaccatggccagcagcgacgaggacggcaccaacggcggcgccagcgaggccggcgaggacagagaggcccccggcgagagaagaagactgggcgtgctggccaccgcctggctgaccttctacgacatcgccatgaccgccggctggctggtgctggccatcgccatggtgagattctacatggagaagggcacccacagaggcctgtacaagagcatccagaagaccctgaagttcttccagaccttcgccctgctggagatcgtgcactgcctgatcggcatcgtgcccaccagcgtgatcgtgaccggcgtgcaggtgagcagcagaatcttcatggtgtggctgatcacccacagcatcaagcccatccagaacgaggagagcgtggtgctgttcctggtggcctggaccgtgaccgagatcaccagatacagcttctacaccttcagcctgctggaccacctgccctacttcatcaagtgggccagatacaacttcttcatcatcctgtaccccgtgggcgtggccggcgagctgctgaccatctacgccgccctgccccacgtgaagaagaccggcatgttcagcatcagactgcccaacaagtacaacgtgagcttcgactactactacttcctgctgatcaccatggccagctacatccccctgttcccccagctgtacttccacatgctgagacagagaagaaaggtgctgcacggcgaggtgatcgtggagaaggacgactag

SEQ ID NO: 95601 - DNA, 1269 bp, Artificial Sequence
  Description of Artificial Sequence: Synthetic coding sequence
atggccggctgcgtgcccctgctgcagggcctggtgctggtgctggccctgcacagagtggagcccagcgccaccagcctgaaggagagacacggcctgcacagcgacagcgcctgcaccggcgtgcaggagagcctgttcctgcccgccagcaaggccaacgacgtgctggtgagatggaagagagccggcagctacctgctggaggagctgttcgagggcaacctggagaaggagtgctacgaggagatctgcgtgtacgaggaggccagagaggtgttcgagaacgaggtggtgaccgacgagttctggagaagatacaagggcggcagcccctgcatcagccagccctgcctgcacaacggcagctgccaggacagcatctggggctacacctgcacctgcagccccggctacgagggcagcaactgcgagctggccaagaacgagtgccaccccgagagaaccgacggctgccagcacttctgcctgcccggccaggagagctacacctgcagctgcgcccagggctacagactgggcgaggaccacaagcagtgcgtgccccacgaccagtgcgcctgcggcgtgctgaccagcgagaagagagcccccgacctgcaggacctgccctggcaggtgaagctgaccaacagcgagggcaaggacttctgcggcggcgtgatcatcagagagaacttcgtgctgaccaccgccaagtgcagcctgctgcacagaaacatcaccgtgaagacctacttcaacagaaccagccaggaccccctgatgatcaagatcacccacgtgcacgtgcacatgagatacgacgccgacgccggcgagaacgacctgagcctgctggagctggagtggcccatccagtgccccggcgccggcctgcccgtgtgcacccccgagaaggacttcgccgagcacctgctgatccccagaaccagaggcctgctgagcggctgggccagaaacggcaccgacctgggcaacagcctgaccaccagacccgtgaccctggtggagggcgaggagtgcggccaggtgctgaacgtgaccgtgaccaccagaacctactgcgagagaagcagcgtggccgccatgcactggatggacggcagcgtggtgaccagagagcacagaggcagctggttcctgaccggcgtgctgggcagccagcccgtgggcggccaggcccacatggtgctggtgaccaaggtgagcagatacagcctgtggttcaagcagatcatgaactag

SEQ ID NO: 95602 - DNA, 1203 bp, Artificial Sequence
  Description of Artificial Sequence: Synthetic coding sequence
atggccggctgcgtgcccctgctgcagggcctggtgctggtgctggccctgcacagagtggagcccagcgtgttcctgcccgccagcaaggccaacgacgtgctggtgagatggaagagagccggcagctacctgctggaggagctgttcgagggcaacctggagaaggagtgctacgaggagatctgcgtgtacgaggaggccagagaggtgttcgagaacgaggtggtgaccgacgagttctggagaagatacaagggcggcagcccctgcatcagccagccctgcctgcacaacggcagctgccaggacagcatctggggctacacctgcacctgcagccccggctacgagggcagcaactgcgagctggccaagaacgagtgccaccccgagagaaccgacggctgccagcacttctgcctgcccggccaggagagctacacctgcagctgcgcccagggctacagactgggcgaggaccacaagcagtgcgtgccccacgaccagtgcgcctgcggcgtgctgaccagcgagaagagagcccccgacctgcaggacctgccctggcaggtgaagctgaccaacagcgagggcaaggacttctgcggcggcgtgatcatcagagagaacttcgtgctgaccaccgccaagtgcagcctgctgcacagaaacatcaccgtgaagacctacttcaacagaaccagccaggaccccctgatgatcaagatcacccacgtgcacgtgcacatgagatacgacgccgacgccggcgagaacgacctgagcctgctggagctggagtggcccatccagtgccccggcgccggcctgcccgtgtgcacccccgagaaggacttcgccgagcacctgctgatccccagaaccagaggcctgctgagcggctgggccagaaacggcaccgacctgggcaacagcctgaccaccagacccgtgaccctggtggagggcgaggagtgcggccaggtgctgaacgtgaccgtgaccaccagaacctactgcgagagaagcagcgtggccgccatgcactggatggacggcagcgtggtgaccagagagcacagaggcagctggttcctgaccggcgtgctgggcagccagcccgtgggcggccaggcccacatggtgctggtgaccaaggtgagcagatacagcctgtggttcaagcagatcatgaactag

SEQ ID NO: 95603 - DNA, 1053 bp, Artificial Sequence
  Description of Artificial Sequence: Synthetic coding sequence
atggagcccaagagaatcagagagggctacctggtgaagaagggcagcgtgttcaacacctggaagcccatgtgggtggtgctgctggaggacggcatcgagttctacaagaagaagagcgacaacagccccaagggcatgatccccctgaagggcagcaccctgaccagcccctgccaggacttcggcaagagaatgttcgtgttcaagatcaccaccaccaagcagcaggaccacttcttccaggccgccttcctggaggagagagacgcctgggtgagagacatcaagaaggccatcaagtgcatcgagggcggccagaagttcgccagaaagagcaccagaagaagcatcagactgcccgagaccatcgacctgggcgccctgtacctgagcatgaaggacaccgagaagggcatcaaggagctgaacctggagaaggacaagaagatcttcaaccactgcttcaccggcaactgcgtgatcgactggctggtgagcaaccagagcgtgagaaacagacaggagggcctgatgatcgccagcagcctgctgaacgagggctacctgcagcccgccggcgacatgagcaagagcgccgtggacggcaccgccgagaaccccttcctggacaaccccgacgccttctactacttccccgacagcggcttcttctgcgaggagaacagcagcgacgacgacgtgatcctgaaggaggagttcagaggcgtgatcatcaagcagggctgcctgctgaagcagggccacagaagaaagaactggaaggtgagaaagttcatcctgagagaggaccccgcctacctgcactactacgaccccgccggcgccgaggaccccctgggcgccatccacctgagaggctgcgtggtgaccagcgtggagagcaacagcaacggcagaaagagcgaggaggagaacctgttcgagatcatcaccgccgacgaggtgcactacttcctgcaggccgccacccccaaggagagaaccgagtggatcagagccatccagatggccagcagaaccggcaagtag

SEQ ID NO: 95604 - DNA, 648 bp, Artificial Sequence
  Description of Artificial Sequence: Synthetic coding sequence
atggccagcctgcagatgagaggcaaccccggcagccacttctgcggcggcaccctgatccaccccagcttcgtgctgaccgccgcccactgcctgagagacatcccccagagactggtgaacgtggtgctgggcgcccacaacgtgagaacccaggagcccacccagcagcacttcagcgtggcccaggtgttcctgaacaactacgacgccgagaacaagctgaacgacgtgctgctgatccagctgagcagccccgccaacctgagcgccagcgtggccaccgtgcagctgccccagcaggaccagcccgtgccccacggcacccagtgcctggccatgggctggggcagagtgggcgcccacgacccccccgcccaggtgctgcaggagctgaacgtgaccgtggtgaccttcttctgcagaccccacaacatctgcaccttcgtgcccagaagaaaggccggcatctgcttcggcgacagcggcggccccctgatctgcgacggcatcatccagggcatcgacagcttcgtgatctggggctgcgccaccagactgttccccgacttcttcaccagagtggccctgtacgtggactggatcagaagcaccctgagaagagtggaggccaagggcagaccctag

SEQ ID NO: 95605 - DNA, 858 bp, Artificial Sequence
  Description of Artificial Sequence: Synthetic coding sequence
atgcccggcgccagaagcggcggcagcggcggcgacggcagcaacagcggcagctacagcggcgacgccagcggcgccgtgaccgtgtgggaggtggtgagcctgctgggcaagctgctgggcaccgtggtggccctgaaggtggtgctgtacctgctgagagtgtgcctggccatggcctggaagagcggcggcgccagccacagcgagctgatccacaacctgagaaagaacggcatcatcaagaccgacaaggtgttcgaggtgatgctggccaccgacagaagccactacgccaagtgcaacccctacatggacagcccccagagcatcggcttccaggccaccatcagcgccccccacatgcacgcctacgccctggagctgctgttcgaccagctgcacgagggcgccaaggccctggacgtgggcagcggcagcggcatcctgaccgcctgcttcgccagaatggtgggctgcaccggcaaggtgatcggcatcgaccacatcaaggagctggtggacgacagcgtgaacaacgtgagaaaggacgaccccaccctgctgagcagcggcagagtgcagctggtggtgggcgacggcagaatgggctacgccgaggaggccccctacgacgccatccacgtgggcgccgccgcccccgtggtgccccaggccctgatcgaccagctgaagcccggcggcagactgatcctgcccgtgggccccgccggcggcaaccagatgctggagcagtacgacaagctgcaggacggcagcatcaagatgaagcccctgatgggcgtgatctacgtgcccctgaccgacaaggagaagcagtggagcagatggaagtag

SEQ ID NO: 95606 - DNA, 684 bp, Artificial Sequence
  Description of Artificial Sequence: Synthetic coding sequence
atggcctggaagagcggcggcgccagccacagcgagctgatccacaacctgagaaagaacggcatcatcaagaccgacaaggtgttcgaggtgatgctggccaccgacagaagccactacgccaagtgcaacccctacatggacagcccccagagcatcggcttccaggccaccatcagcgccccccacatgcacgcctacgccctggagctgctgttcgaccagctgcacgagggcgccaaggccctggacgtgggcagcggcagcggcatcctgaccgcctgcttcgccagaatggtgggctgcaccggcaaggtgatcggcatcgaccacatcaaggagctggtggacgacagcgtgaacaacgtgagaaaggacgaccccaccctgctgagcagcggcagagtgcagctggtggtgggcgacggcagaatgggctacgccgaggaggccccctacgacgccatccacgtgggcgccgccgcccccgtggtgccccaggccctgatcgaccagctgaagcccggcggcagactgatcctgcccgtgggccccgccggcggcaaccagatgctggagcagtacgacaagctgcaggacggcagcatcaagatgaagcccctgatgggcgtgatctacgtgcccctgaccgacaaggagaagcagtggagcagatggaagtag

SEQ ID NO: 95607 - DNA, 861 bp, Artificial Sequence
  Description of Artificial Sequence: Synthetic coding sequence
atgcccggcgccagaagcggcggcagcggcggcgacggcagcaacagcggcagctacagcggcgacgccagcggcgccgtgaccgtgtgggaggtggtgagcctgctgggcaagctgctgggcaccgtggtggccctgaaggtggtgctgtacctgctgagagtgtgcctggccatggcctggaagagcggcggcgccagccacagcgagctgatccacaacctgagaaagaacggcatcatcaagaccgacaaggtgttcgaggtgatgctggccaccgacagaagccactacgccaagtgcaacccctacatggacagcccccagagcatcggcttccaggccaccatcagcgccccccacatgcacgcctacgccctggagctgctgttcgaccagctgcacgagggcgccaaggccctggacgtgggcagcggcagcggcatcctgaccgcctgcttcgccagaatggtgggctgcaccggcaaggtgatcggcatcgaccacatcaaggagctggtggacgacagcgtgaacaacgtgagaaaggacgaccccaccctgctgagcagcggcagagtgcagctggtggtgggcgacggcagaatgggctacgccgaggaggccccctacgacgccatccacgtgggcgccgccgcccccgtggtgccccaggccctgatcgaccagctgaagcccggcggcagactgatcctgcccgtgggccccgccggcggcaaccagatgctggagcagtacgacaagctgcaggacggcagcatcaagatgaagcccctgatgggcgtgatctacgtgcccctgaccgacaaggagaagcagtggagcagagacgagctgtag

SEQ ID NO: 95608 - DNA, 858 bp, Artificial Sequence; identical to SEQ ID NO: 95605
  Description of Artificial Sequence: Synthetic coding sequence

SEQ ID NO: 95609 - DNA, 579 bp, Artificial Sequence
  Description of Artificial Sequence: Synthetic coding sequence
atggcctggaagagcggcggcgccagccacagcgagctgatccacaacctgagaagcttccaggccaccatcagcgccccccacatgcacgcctacgccctggagctgctgttcgaccagctgcacgagggcgccaaggccctggacgtgggcagcggcagcggcatcctgaccgcctgcttcgccagaatggtgggctgcaccggcaaggtgatcggcatcgaccacatcaaggagctggtggacgacagcgtgaacaacgtgagaaaggacgaccccaccctgctgagcagcggcagagtgcagctggtggtgggcgacggcagaatgggctacgccgaggaggccccctacgacgccatccacgtgggcgccgccgcccccgtggtgccccaggccctgatcgaccagctgaagcccggcggcagactgatcctgcccgtgggccccgccggcggcaaccagatgctggagcagtacgacaagctgcaggacggcagcatcaagatgaagcccctgatgggcgtgatctacgtgcccctgaccgacaaggagaagcagtggagcagatggaagtag

SEQ ID NO: 95610 - DNA, 2016 bp, Artificial Sequence
  Description of Artificial Sequence: Synthetic coding sequence
atgaagcagatcttcttcctggacgacagcggcccccccttcggccacatggtgctggccctgggcggctacctgggcggcttcgacggcaacttcctgtggaacagaatcggcgccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95611 - DNA, 2088 bp, Artificial Sequence
  Description of Artificial Sequence: Synthetic coding sequence
atgtggggcttcctgaagagacccgtggtggtgaccgccgacatcaacctgagcctggtggccctgaccggcatgggcctgctgagcagactgtggagactgacctaccccagagccgtggtgctgttcagaagaatcagatggcagttcttcgtggagcagaactggagcagcgtggtggccttccccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95612 - DNA, 1041 bp, Artificial Sequence
  Description of Artificial Sequence: Synthetic coding sequence
tggagaggcggcggctgcaccagccccgccaccctgggcgccgccagaggcgccgtgggcatcggcaaggagggccagtaccagcccctgatcgccagcctgacctggggcctggtgcccctgagccaggcccaggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95613 - DNA, 471 bp, Artificial Sequence
  Description of Artificial Sequence: Synthetic coding sequence
atggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagcctgcccctgtgggcccccagacccaaccacgtgcagtgcctgcccggccagctgagaggcagaaccagcagcgaccacagcggcagcgccaccggcggcggcctgtgggtgcccggccacagcgaggagagactgtgggagacctgcgccctgctggccagcttcccccccggccacctgccccacgacgtgagatacgagaacggcagaggcagcagccaccagcagcaggtgacctgctaccccttcaaggacgtgaacaactggtggatcgtgaagtag

SEQ ID NO: 95614 - DNA, 2244 bp, Artificial Sequence
  Description of Artificial Sequence: Synthetic coding sequence
atgtggggcttcctgaagagacccgtggtggtgaccgccgacatcaacctgagcctggtggccctgaccggcatgggcctgctgagcagactgtggagactgacctaccccagagccgtggtgttcgacgaggtgtactacggccagtacatcagcttctacatgaagcagatcttcttcctggacgacagcggcccccccttcggccacatggtgctggccctgggcggctacctgggcggcttcgacggcaacttcctgtggaacagaatcggcgccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgggcgccgacgtgcagtgctgcatgagacccgcctgcatgggccagatgcagatgagccagggcgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95615 - DNA, 2178 bp, Artificial Sequence
  Description of Artificial Sequence: Synthetic coding sequence
atgtggggcttcctgaagagacccgtggtggtgaccgccgacatcaacctgagcctggtggccctgaccggcatgggcctgctgagcagactgtggagactgacctaccccagagccgtggtgttcgacgaggtgtactacggccagtacatcagcttctacatgaagcagatcttcttcctggacgacagcggcccccccttcggccacatggtgctggccctgggcggctacctgggcggcttcgacggcaacttcctgtggaacagaatcggcgccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95616 - DNA, 1827 bp, Artificial Sequence
  Description of Artificial Sequence: Synthetic coding sequence
atggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95617 - DNA, 471 bp, Artificial Sequence; identical to SEQ ID NO: 95613
  Description of Artificial Sequence: Synthetic coding sequence

SEQ ID NO: 95618 - DNA, 429 bp, Artificial Sequence
  Description of Artificial Sequence: Synthetic coding sequence
atgtggggcttcctgaagagacccgtggtggtgaccgccgacatcaacctgagcctggtggccctgaccggcatgggcctgctgagcagactgtggagactgacctaccccagagccgtggtgttcgacgaggtgtactacggccagtacatcagcttctacatgaagcagatcttcttcctggacgacagcggcccccccttcggccacatggtgctggccctgggcggctacctgggcggcttcgacggcaacttcctgtggaacagaatcggcgccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatctag

SEQ ID NO: 95619 - DNA, 1722 bp, Artificial Sequence
  Description of Artificial Sequence: Synthetic coding sequence
atgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcagtggagaatgctggccctgagaagcgacgacagcgagcacaagtacagcagcagccccctggagtgggtgaccctggacaccaacatcgcctactggctgcaccccagaaccagcgcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95620 - DNA, 2178 bp, Artificial Sequence; identical to SEQ ID NO: 95615
  Description of Artificial Sequence: Synthetic coding sequence

SEQ ID NO: 95621 - DNA, 507 bp, Artificial Sequence
  Description of Artificial Sequence: Synthetic coding sequence
atggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagtag

SEQ ID NO: 95622 - DNA, 894 bp, Artificial Sequence
  Description of Artificial Sequence: Synthetic coding sequence
atggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgggcgccgacgtgcagtgctgcatgagacccgcctgcatgggccagatgcagatgagccagggcgtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacctag

SEQ ID NO: 95623 - DNA, 657 bp, Artificial Sequence
  Description of Artificial Sequence: Synthetic coding sequence
atgaagcagatcttcttcctggacgacagcggcccccccttcggccacatggtgctggccctgggcggctacctgggcggcttcgacggcaacttcctgtggaacagaatcggcgccgagtacagcagcaacgtgcccgtgtggagcctgagactgctgcccgccctggccggcgccctgagcgtgcccatggcctaccagatcgtgctggagctgcacttcagccactgcgccgccatgggcgccgccctgctgatgctgatcgagaacgccctgatcacccagagcagactgatgctgctggagagcgtgctgatcttcttcaacctgctggccgtgctgagctacctgaagttcttcaactgccagaagcacagccccttcagcctgagctggtggttctggctgaccctgaccggcgtggcctgcagctgcgccgtgggcatcaagtacatgggcgtgttcacctacgtgctggtgctgggcgtggccgccgtgcacgcctggcacctgctgggcgaccagaccctgagcaacgtgggcgccgacgtgcagtgctgcatgagacccgcctgcatgggccagatgcagatgagccagggcgtgtgcgtgttctgccacctgctggccagagccgtggccctgctggtgatctag

SEQ ID NO: 95624 - DNA, 1398 bp, Artificial Sequence
  Description of Artificial Sequence: Synthetic coding sequence
atggccatcttctgcggcaccgagctggagcaggtgtgcgtgttctgccacctgctggccagagccgtggccctgctggtgatccccgtggtgctgtacctgctgttcttctacgtgcacctgatcctggtgttcagaagcggcccccacgaccagatcatgagcagcgccttccaggccagcctggagggcggcctggccagaatcacccagggccagcccctggaggtggccttcggcagccaggtgaccctgagaaacgtgttcggcaagcccgtgccctgctggctgcacagccaccaggacacctaccccatgatctacgagaacggcagaggcagcagccaccagcagcaggtgacctgctaccccttcaaggacgtgaacaactggtggatcgtgaaggaccccagaagacaccagctggtggtgagcagcccccccagacccgtgagacacggcgacatggtgcagctggtgcacggcatgaccaccagaagcctgaacacccacgacgtggccgcccccctgagcccccacagccaggaggtgagctgctacatcgactacaacatcagcatgcccgcccagaacctgtggagactggagatcgtgaacagaggcagcgacaccgacgtgtggaagaccatcctgagcgaggtgagattcgtgcacgtgaacaccagcgccgtgctgaagctgagcggcgcccacctgcccgactggggctacagacagctggagatcgtgggcgagaagctgagcagaggctaccacggcagcaccgtgtggaacgtggaggagcacagatacggcgccagccaggagcagagagagagagagagagagctgcacagccccgcccaggtggacgtgagcagaaacctgagcttcatggccagattcagcgagctgcaggcccagatccacctgctgggcaacatcgtgatctgggtgagcggcagcctggccctggccatctacgccctgctgagcctgtggtacctgctgagaagaagaagaaacgtgcacgacctgccccaggacgcctggctgagatgggtgctggccggcgccctgtgcgccggcggctgggccgtgaactacctgcccttcttcctgatggagaagaccctgttcctgtaccactacctgcccgccctgaccttccagatcctgctgctgcccgtggtgctgcagcacatcagcgaccacctgtgcagaagccagctgcagagaagcatcttcagcgccctggtggtggcctggtacagcagcgcctgccacgtgagcaacaccctgagacccctgacctacggcgacaagagcctgagcccccacgagctgaaggccctgagatggaaggacagctgggacatcctgatcagaaagcactag

SEQ ID NO: 95625 - DNA, 2253 bp, Artificial Sequence
  Description of Artificial Sequence: Synthetic coding sequence
atgccccccgccaccggcggcggcctggccgagagcgagctgagacccagaagaggcagatgcggcccccaggccgccagagccgccggcagagacgtggccgccgaggccgtggccagaagccccaagagacccgcctggggcagcagaagattcgaggccgtgggctggtgggccctgctggccctggtgaccctgctgagcttcgccaccagattccacagactggacgagcccccccacatctgctgggacgagacccacttcggcaagatgggcagctactacatcaacagaaccttcttcttcgacgtgcacccccccctgggcaagatgctgatcggcctggccggctacctgagcggctacgacggcaccttcctgttccagaagcccggcgacaagtacgagcaccacagctacatgggcatgagaggcttctgcgccttcctgggcagctggctggtgcccttcgcctacctgaccgtgctggacctgagcaagagcctgagcgccgccctgctgaccgccgccctgctgaccttcgacaccggctgcctgaccctgagccagtacatcctgctggaccccatcctgatgttcttcatcatggccgccatgctgagcatggtgaagtacaacagctgcgccgacagacccttcagcgccccctggtggttctggctgagcctgaccggcgtgagcctggccggcgccctgggcgtgaagttcgtgggcctgttcatcatcctgcaggtgggcctgaacaccatcgccgacctgtggtacctgttcggcgacctgagcctgagcctggtgaccgtgggcaagcacctgaccgccagagtgctgtgcctgatcgtgctgcccctggccctgtacaccgccaccttcgccgtgcacttcatggtgctgagcaagagcggccccggcgacggcttcttcagcagcgccttccaggccagactgagcggcaacaacctgcacaacgccagcatccccgagcacctggcctacggcagcgtgatcaccgtgaagaacctgagaatggccatcggctacctgcacagccacagacacctgtaccccgagggcatcggcgccagacagcagcaggtgaccacctacctgcacaaggactacaacaacctgtggatcatcaagaagcacaacaccaacagcgaccccctggaccccagcttccccgtggagttcgtgagacacggcgacatcatcagactggagcacaaggagaccagcagaaacctgcacagccactaccacgaggcccccatgaccagaaagcactaccaggtgaccggctacggcatcaacggcaccggcgacagcaacgacttctggagaatcgaggtggtgaacagaaagttcggcaacagaatcaaggtgctgagaagcagaatcagattcatccacctggtgaccggctgcgtgctgggcagcagcggcaaggtgctgcccaagtggggctgggagcagctggaggtgacctgcaccccctacctgaaggagaccctgaacagcatctggaacgtggaggaccacatcaaccccaagctgcccaacatcagcctggacgtgctgcagcccagcttccccgagatcctgctggagagccacatggtgatgatcagaggcaacagcggcctgaagcccaaggacaacgagttcaccagcaagccctggcactggcccatcaactaccagggcctgagattcagcggcgtgaacgacaccgacttcagagtgtacctgctgggcaaccccgtggtgtggtggctgaacctgctgagcatcgccctgtacctgctgagcggcagcatcatcgccgtggccatgcagagaggcgccagactgcccgccgaggtggccggcctgagccaggtgctgctgagaggcggcggccaggtgctgctgggctggaccctgcactacttccccttcttcctgatgggcagagtgctgtacttccaccactacttccccgccatgctgttcagcagcatgctgaccggcatcctgtgggacaccctgctgagactgtgcgcctggggcctggccagctggcccctggccagaggcatccacgtggccggcatcctgagcctgctgctgggcaccgcctacagcttctacctgttccaccccctggcctacggcatggtgggccccctggcccaggacccccagagccccatggccggcctgagatggctggacagctgggacttctag

SEQ ID NO: 95626 - DNA, 669 bp, Artificial Sequence
  Description of Artificial Sequence: Synthetic coding sequence
atgaagctgcccctgctgctggccctgctgttcggcgccgtgagcgccctgcacctgagaagcgagaccagcaccttcgagacccccctgggcgccaagaccctgcccgaggacgaggagacccccgagcaggagatggaggagaccccctgcagagagctggaggaggaggaggagtggggcagcggcagcgaggacgccagcaagaaggacggcgccgtggagagcatcagcgtgcccgacatggtggacaagaacctgacctgccccgaggaggaggacaccgtgaaggtggtgggcatccccggctgccagacctgcagatacctgctggtgagaagcctgcagaccttcagccaggcctggttcacctgcagaagatgctacagaggcaacctggtgagcatccacaacttcaacatcaactacagaatccagtgcagcgtgagcgccctgaaccagggccaggtgtggatcggcggcagaatcaccggcagcggcagatgcagaagattccagtgggtggacggcagcagatggaacttcgcctactgggccgcccaccagccctggagcagaggcggccactgcgtggccctgtgcaccagaggcggccactggagaagagcccactgcctgagaagactgcccttcatctgcagctactag

SEQ ID NO: 95627 - DNA, 669 bp, Artificial Sequence; identical to SEQ ID NO: 95626
  Description of Artificial Sequence: Synthetic coding sequence

SEQ ID NO: 95628 - DNA, 636 bp, Artificial Sequence
  Description of Artificial Sequence: Synthetic coding sequence
atgaagctgcccctgctgctggccctgctgttcggcgccgtgagcgccctgcacctgagaagcgagaccagcaccttcgagacccccctgggcgccaagaccctgcccgaggacgaggagacccccgagcaggagatggaggagaccccctgcagagagctggaggaggaggaggagtggggcagcggcagcgaggacgccagcaagaaggacggcgccgtggagagcatcagcgtgcccgacatggtggacaagaacctgacctgccccgaggaggaggacaccgtgaaggtggtgggcatccccggctgccagacctgcagatacctgctgttcacctgcagaagatgctacagaggcaacctggtgagcatccacaacttcaacatcaactacagaatccagtgcagcgtgagcgccctgaaccagggccaggtgtggatcggcggcagaatcaccggcagcggcagatgcagaagattccagtgggtggacggcagcagatggaacttcgcctactgggccgcccaccagccctggagcagaggcggccactgcgtggccctgtgcaccagaggcggccactggagaagagcccactgcctgagaagactgcccttcatctgcagctactag

SEQ ID NO: 95629 - DNA, 678 bp, Artificial Sequence
  Description of Artificial Sequence: Synthetic coding sequence
atgcagtgcctgctgctgctgcccttcctgctgctgggcaccgtgagcgccctgcacctggagaacgacgccccccacctggagagcctggagacccaggccgacctgggccaggacctggacagcagcaaggagcaggagagagacctggccctgaccgaggaggtgatccaggccgagggcgaggaggtgaaggccagcgcctgccaggacaacttcgaggacgaggaggccatggagagcgaccccgccgccctggacaaggacttccagtgccccagagaggaggacatcgtggaggtgcagggcagccccagatgcaagatctgcagatacctgctggtgagaacccccaagaccttcgccgaggcccagaacgtgtgcagcagatgctacggcggcaacctggtgagcatccacgacttcaacttcaactacagaatccagtgctgcaccagcaccgtgaaccaggcccaggtgtggatcggcggcaacctgagaggctggttcctgtggaagagattctgctggaccgacggcagccactggaacttcgcctactggagccccggccagcccggcaacggccagggcagctgcgtggccctgtgcaccaagggcggctactggagaagagcccagtgcgacaagcagctgcccttcgtgtgcagcttctag

SEQ ID NO: 95630 - DNA, 4092 bp, Artificial Sequence
  Description of Artificial Sequence: Synthetic coding sequence
atggcctggaagaccctgcccatctacctgctgctgctgctgagcgtgttcgtgatccagcaggtgagcagccaggagctgagctgcaagggcagatgcttcgagagcttcgagagaggcagagagtgcgactgcgacgcccagtgcaagaagtacgacaagtgctgccccgactacgagagcttctgcgccgaggtgcacaaccccaccagcccccccagcagcaagaaggcccccccccccagcggcgccagccagaccatcaagagcaccaccaagagaagccccaagccccccaacaagaagaagaccaagaaggtgatcgagagcgaggagatcaccgaggagcacagcgtgagcgagaaccaggagagcagcagcagcagcagcagcagcagcagcagcagcaccatcagaaagatcaagagcagcaagaacagcgccgccaacagagagctgcagaagaagctgaaggtgaaggacaacaagaagaacagaaccaagaagaagcccacccccaagccccccgtggtggacgaggccggcagcggcctggacaacggcgacttcaaggtgaccacccccgacaccagcaccacccagcacaacaaggtgagcaccagccccaagatcaccaccgccaagcccatcaaccccagacccagcctgccccccaacagcgacaccagcaaggagaccagcctgaccgtgaacaaggagaccaccgtggagaccaaggagaccaccaccaccaacaagcagaccagcaccgacggcaaggagaagaccaccagcgccaaggagacccagagcatcgagaagaccagcgccaaggacctggcccccaccagcaaggtgctggccaagcccacccccaaggccgagaccaccaccaagggccccgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagctgacccccaccacccccgagaagctggcccccaccacccccgagaagcccgcccccaccacccccgaggagctggcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccaccctgaaggagcccgcccccaccacccccaagaagcccgcccccaaggagctggcccccaccaccaccaaggagcccaccagcaccacctgcgacaagcccgcccccaccacccccaagggcaccgcccccaccacccccaaggagcccgcccccaccacccccaaggagcccgcccccaccacccccaagggcaccgcccccaccaccctgaaggagcccgcccccaccacccccaagaagcccgcccccaaggagctggcccccaccaccaccaagggccccaccagcaccaccagcgacaagcccgcccccaccacccccaaggagaccgcccccaccacccccaaggagcccgcccccaccacccccaagaagcccgcccccaccacccccgagacccccccccccaccaccagcgaggtgagcacccccaccaccaccaaggagcccaccaccatccacaagagccccgacgagagcacccccgagctgagcgccgagcccacccccaaggccctggagaacagccccaaggagcccggcgtgcccaccaccaagacccccgccgccaccaagcccgagatgaccaccaccgccaaggacaagaccaccgagagagacctgagaaccacccccgagaccaccaccgccgcccccaagatgaccaaggagaccgccaccaccaccgagaagaccaccgagagcaagatcaccgccaccaccacccaggtgaccagcaccaccacccaggacaccacccccttcaagatcaccaccctgaagaccaccaccctggcccccaaggtgaccaccaccaagaagaccatcaccaccaccgagatcatgaacaagcccgaggagaccgccaagcccaaggacagagccaccaacagcaaggccaccacccccaagccccagaagcccaccaaggcccccaagaagcccaccagcaccaagaagcccaagaccatgcccagagtgagaaagcccaagaccacccccacccccagaaagatgaccagcaccatgcccgagctgaaccccaccagcagaatcgccgaggccatgctgcagaccaccaccagacccaaccagacccccaacagcaagctggtggaggtgaaccccaagagcgaggacgccggcggcgccgagggcgagaccccccacatgctgctgagaccccacgtgttcatgcccgaggtgacccccgacatggactacctgcccagagtgcccaaccagggcatcatcatcaaccccatgctgagcgacgagaccaacatctgcaacggcaagcccgtggacggcctgaccaccctgagaaacggcaccctggtggccttcagaggccactacttctggatgctgagccccttcagcccccccagccccgccagaagaatcaccgaggtgtggggcatccccagccccatcgacaccgtgttcaccagatgcaactgcgagggcaagaccttcttcttcaaggacagccagtactggagattcaccaacgacatcaaggacgccggctaccccaagcccatcttcaagggcttcggcggcctgaccggccagatcgtggccgccctgagcaccgccaagtacaagaactggcccgagagcgtgtacttcttcaagagaggcggcagcatccagcagtacatctacaagcaggagcccgtgcagaagtgccccggcagaagacccgccctgaactaccccgtgtacggcgagaccacccaggtgagaagaagaagattcgagagagccatcggccccagccagacccacaccatcagaatccagtacagccccgccagactggcctaccaggacaagggcgtgctgcacaacgaggtgaaggtgagcatcctgtggagaggcctgcccaacgtggtgaccagcgccatcagcctgcccaacatcagaaagcccgacggctacgactactacgccttcagcaaggaccagtactacaacatcgacgtgcccagcagaaccgccagagccatcaccaccagaagcggccagaccctgagcaaggtgtggtacaactgcccctag

SEQ ID NO: 95631 - DNA, 2802 bp, Artificial Sequence
  Description of Artificial Sequence: Synthetic coding sequence
atggcctggaagaccctgcccatctacctgctgctgctgctgagcgtgttcgtgatccagcaggtgagcagccaggagctgagctgcaagggcagatgcttcgagagcttcgagagaggcagagagtgcgactgcgacgcccagtgcaagaagtacgacaagtgctgccccgactacgagagcttctgcgccgaggtgcacaaccccaccagcccccccagcagcaagaaggcccccccccccagcggcgccagccagaccatcaagagcaccaccaagagaagccccaagccccccaacaagaagaagaccaagaaggtgatcgagagcgaggagatcaccgaggagcacagcgtgagcgagaaccaggagagcagcagcagcagcagcagcagcagcagcagcagcaccatcagaaagatcaagagcagcaagaacagcgccgccaacagagagctgcagaagaagctgaaggtgaaggacaacaagaagaacagaaccaagaagaagcccacccccaagccccccgtggtggacgaggccggcagcggcctggacaacggcgacttcaaggtgaccacccccgacaccagcaccacccagcacaacaaggtgagcaccagccccaagatcaccaccgccaagcccatcaaccccagacccagcctgccccccaacagcgacaccagcaaggagaccagcctgaccgtgaacaaggagaccaccgtggagaccaaggagaccaccaccaccaacaagcagaccagcaccgacggcaaggagaagaccaccagcgccaaggagacccagagcatcgagaagaccagcgccaaggacctggcccccaccagcaaggtgctggccaagcccacccccaaggccgagaccaccaccaagggccccgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaagaagcccgcccccaccacccccgagacccccccccccaccaccagcgaggtgagcacccccaccaccaccaaggagcccaccaccatccacaagagccccgacgagagcacccccgagctgagcgccgagcccacccccaaggccctggagaacagccccaaggagcccggcgtgcccaccaccaagacccccgccgccaccaagcccgagatgaccaccaccgccaaggacaagaccaccgagagagacctgagaaccacccccgagaccaccaccgccgcccccaagatgaccaaggagaccgccaccaccaccgagaagaccaccgagagcaagatcaccgccaccaccacccaggtgaccagcaccaccacccaggacaccacccccttcaagatcaccaccctgaagaccaccaccctggcccccaaggtgaccaccaccaagaagaccatcaccaccaccgagatcatgaacaagcccgaggagaccgccaagcccaaggacagagccaccaacagcaaggccaccacccccaagccccagaagcccaccaaggcccccaagaagcccaccagcaccaagaagcccaagaccatgcccagagtgagaaagcccaagaccacccccacccccagaaagatgaccagcaccatgcccgagctgaaccccaccagcagaatcgccgaggccatgctgcagaccaccaccagacccaaccagacccccaacagcaagctggtggaggtgaaccccaagagcgaggacgccggcggcgccgagggcgagaccccccacatgctgctgagaccccacgtgttcatgcccgaggtgacccccgacatggactacctgcccagagtgcccaaccagggcatcatcatcaaccccatgctgagcgacgagaccaacatctgcaacggcaagcccgtggacggcctgaccaccctgagaaacggcaccctggtggccttcagaggccactacttctggatgctgagccccttcagcccccccagccccgccagaagaatcaccgaggtgtggggcatccccagccccatcgacaccgtgttcaccagatgcaactgcgagggcaagaccttcttcttcaaggacagccagtactggagattcaccaacgacatcaaggacgccggctaccccaagcccatcttcaagggcttcggcggcctgaccggccagatcgtggccgccctgagcaccgccaagtacaagaactggcccgagagcgtgtacttcttcaagagaggcggcagcatccagcagtacatctacaagcaggagcccgtgcagaagtgccccggcagaagacccgccctgaactaccccgtgtacggcgagaccacccaggtgagaagaagaagattcgagagagccatcggccccagccagacccacaccatcagaatccagtacagccccgccagactggcctaccaggacaagggcgtgctgcacaacgaggtgaaggtgagcatcctgtggagaggcctgcccaacgtggtgaccagcgccatcagcctgcccaacatcagaaagcccgacggctacgactactacgccttcagcaaggaccagtactacaacatcgacgtgcccagcagaaccgccagagccatcaccaccagaagcggccagaccctgagcaaggtgtggtacaactgcccctag

SEQ ID NO: 95632 - DNA, 3936 bp, Artificial Sequence
  Description of Artificial Sequence: Synthetic coding sequence
atggcctggaagaccctgcccatctacctgctgctgctgctgagcgtgttcgtgatccagcaggtgagcagccaggacctgagcagctgcgccggcagatgcggcgagggctacagcagagacgccacctgcaactgcgactacaactgccagcactacatggagtgctgccccgacttcaagagagtgtgcaccgccgagctgagctgcaagggcagatgcttcgagagcttcgagagaggcagagagtgcgactgcgacgcccagtgcaagaagtacgacaagtgctgccccgactacgagagcttctgcgccgaggtgaaggacaacaagaagaacagaaccaagaagaagcccacccccaagccccccgtggtggacgaggccggcagcggcctggacaacggcgacttcaaggtgaccacccccgacaccagcaccacccagcacaacaaggtgagcaccagccccaagatcaccaccgccaagcccatcaaccccagacccagcctgccccccaacagcgacaccagcaaggagaccagcctgaccgtgaacaaggagaccaccgtggagaccaaggagaccaccaccaccaacaagcagaccagcaccgacggcaaggagaagaccaccagcgccaaggagacccagagcatcgagaagaccagcgccaaggacctggcccccaccagcaaggtgctggccaagcccacccccaaggccgagaccaccaccaagggccccgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagctgacccccaccacccccgagaagctggcccccaccacccccgagaagcccgcccccaccacccccgaggagctggcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccaccctgaaggagcccgcccccaccacccccaagaagcccgcccccaaggagctggcccccaccaccaccaaggagcccaccagcaccacctgcgacaagcccgcccccaccacccccaagggcaccgcccccaccacccccaaggagcccgcccccaccacccccaaggagcccgcccccaccacccccaagggcaccgcccccaccaccctgaaggagcccgcccccaccacccccaagaagcccgcccccaaggagctggcccccaccaccaccaagggccccaccagcaccaccagcgacaagcccgcccccaccacccccaaggagaccgcccccaccacccccaaggagcccgcccccaccacccccaagaagcccgcccccaccacccccgagacccccccccccaccaccagcgaggtgagcacccccaccaccaccaaggagcccaccaccatccacaagagccccgacgagagcacccccgagctgagcgccgagcccacccccaaggccctggagaacagccccaaggagcccggcgtgcccaccaccaagacccccgccgccaccaagcccgagatgaccaccaccgccaaggacaagaccaccgagagagacctgagaaccacccccgagaccaccaccgccgcccccaagatgaccaaggagaccgccaccaccaccgagaagaccaccgagagcaagatcaccgccaccaccacccaggtgaccagcaccaccacccaggacaccacccccttcaagatcaccaccctgaagaccaccaccctggcccccaaggtgaccaccaccaagaagaccatcaccaccaccgagatcatgaacaagcccgaggagaccgccaagcccaaggacagagccaccaacagcaaggccaccacccccaagccccagaagcccaccaaggcccccaagaagcccaccagcaccaagaagcccaagaccatgcccagagtgagaaagcccaagaccacccccacccccagaaagatgaccagcaccatgcccgagctgaaccccaccagcagaatcgccgaggccatgctgcagaccaccaccagacccaaccagacccccaacagcaagctggtggaggtgaaccccaagagcgaggacgccggcggcgccgagggcgagaccccccacatgctgctgagaccccacgtgttcatgcccgaggtgacccccgacatggactacctgcccagagtgcccaaccagggcatcatcatcaaccccatgctgagcgacgagaccaacatctgcaacggcaagcccgtggacggcctgaccaccctgagaaacggcaccctggtggccttcagaggccactacttctggatgctgagccccttcagcccccccagccccgccagaagaatcaccgaggtgtggggcatccccagccccatcgacaccgtgttcaccagatgcaactgcgagggcaagaccttcttcttcaaggacagccagtactggagattcaccaacgacatcaaggacgccggctaccccaagcccatcttcaagggcttcggcggcctgaccggccagatcgtggccgccctgagcaccgccaagtacaagaactggcccgagagcgtgtacttcttcaagagaggcggcagcatccagcagtacatctacaagcaggagcccgtgcagaagtgccccggcagaagacccgccctgaactaccccgtgtacggcgagaccacccaggtgagaagaagaagattcgagagagccatcggccccagccagacccacaccatcagaatccagtacagccccgccagactggcctaccaggacaagggcgtgctgcacaacgaggtgaaggtgagcatcctgtggagaggcctgcccaacgtggtgaccagcgccatcagcctgcccaacatcagaaagcccgacggctacgactactacgccttcagcaaggaccagtactacaacatcgacgtgcccagcagaaccgccagagccatcaccaccagaagcggccagaccctgagcaaggtgtggtacaactgcccctag

SEQ ID NO: 95633 - DNA, 4086 bp, Artificial Sequence
  Description of Artificial Sequence: Synthetic coding sequence
atggcctggaagaccctgcccatctacctgctgctgctgctgagcgtgttcgtgatccagcaggtgagcagccaggacctgagcagctgcgccggcagatgcggcgagggctacagcagagacgccacctgcaactgcgactacaactgccagcactacatggagtgctgccccgacttcaagagagtgtgcaccgccgagctgagctgcaagggcagatgcttcgagagcttcgagagaggcagagagtgcgactgcgacgcccagtgcaagaagtacgacaagtgctgccccgactacgagagcttctgcgccgaggtgcacaaccccaccagcccccccagcagcaagaaggcccccccccccagcggcgccagccagaccatcaagagcaccaccaagagaagccccaagccccccaacaagaagaagaccaagaaggtgatcgagagcgaggagatcaccgaggtgaaggacaacaagaagaacagaaccaagaagaagcccacccccaagccccccgtggtggacgaggccggcagcggcctggacaacggcgacttcaaggtgaccacccccgacaccagcaccacccagcacaacaaggtgagcaccagccccaagatcaccaccgccaagcccatcaaccccagacccagcctgccccccaacagcgacaccagcaaggagaccagcctgaccgtgaacaaggagaccaccgtggagaccaaggagaccaccaccaccaacaagcagaccagcaccgacggcaaggagaagaccaccagcgccaaggagacccagagcatcgagaagaccagcgccaaggacctggcccccaccagcaaggtgctggccaagcccacccccaaggccgagaccaccaccaagggccccgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagctgacccccaccacccccgagaagctggcccccaccacccccgagaagcccgcccccaccacccccgaggagctggcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccaccctgaaggagcccgcccccaccacccccaagaagcccgcccccaaggagctggcccccaccaccaccaaggagcccaccagcaccacctgcgacaagcccgcccccaccacccccaagggcaccgcccccaccacccccaaggagcccgcccccaccacccccaaggagcccgcccccaccacccccaagggcaccgcccccaccaccctgaaggagcccgcccccaccacccccaagaagcccgcccccaaggagctggcccccaccaccaccaagggccccaccagcaccaccagcgacaagcccgcccccaccacccccaaggagaccgcccccaccacccccaaggagcccgcccccaccacccccaagaagcccgcccccaccacccccgagacccccccccccaccaccagcgaggtgagcacccccaccaccaccaaggagcccaccaccatccacaagagccccgacgagagcacccccgagctgagcgccgagcccacccccaaggccctggagaacagccccaaggagcccggcgtgcccaccaccaagacccccgccgccaccaagcccgagatgaccaccaccgccaaggacaagaccaccgagagagacctgagaaccacccccgagaccaccaccgccgcccccaagatgaccaaggagaccgccaccaccaccgagaagaccaccgagagcaagatcaccgccaccaccacccaggtgaccagcaccaccacccaggacaccacccccttcaagatcaccaccctgaagaccaccaccctggcccccaaggtgaccaccaccaagaagaccatcaccaccaccgagatcatgaacaagcccgaggagaccgccaagcccaaggacagagccaccaacagcaaggccaccacccccaagccccagaagcccaccaaggcccccaagaagcccaccagcaccaagaagcccaagaccatgcccagagtgagaaagcccaagaccacccccacccccagaaagatgaccagcaccatgcccgagctgaaccccaccagcagaatcgccgaggccatgctgcagaccaccaccagacccaaccagacccccaacagcaagctggtggaggtgaaccccaagagcgaggacgccggcggcgccgagggcgagaccccccacatgctgctgagaccccacgtgttcatgcccgaggtgacccccgacatggactacctgcccagagtgcccaaccagggcatcatcatcaaccccatgctgagcgacgagaccaacatctgcaacggcaagcccgtggacggcctgaccaccctgagaaacggcaccctggtggccttcagaggccactacttctggatgctgagccccttcagcccccccagccccgccagaagaatcaccgaggtgtggggcatccccagccccatcgacaccgtgttcaccagatgcaactgcgagggcaagaccttcttcttcaaggacagccagtactggagattcaccaacgacatcaaggacgccggctaccccaagcccatcttcaagggcttcggcggcctgaccggccagatcgtggccgccctgagcaccgccaagtacaagaactggcccgagagcgtgtacttcttcaagagaggcggcagcatccagcagtacatctacaagcaggagcccgtgcagaagtgccccggcagaagacccgccctgaactaccccgtgtacggcgagaccacccaggtgagaagaagaagattcgagagagccatcggccccagccagacccacaccatcagaatccagtacagccccgccagactggcctaccaggacaagggcgtgctgcacaacgaggtgaaggtgagcatcctgtggagaggcctgcccaacgtggtgaccagcgccatcagcctgcccaacatcagaaagcccgacggctacgactactacgccttcagcaaggaccagtactacaacatcgacgtgcccagcagaaccgccagagccatcaccaccagaagcggccagaccctgagcaaggtgtggtacaactgcccctag

SEQ ID NO: 95634 - DNA, 4215 bp, Artificial Sequence
  Description of Artificial Sequence: Synthetic coding sequence
atggcctggaagaccctgcccatctacctgctgctgctgctgagcgtgttcgtgatccagcaggtgagcagccaggacctgagcagctgcgccggcagatgcggcgagggctacagcagagacgccacctgcaactgcgactacaactgccagcactacatggagtgctgccccgacttcaagagagtgtgcaccgccgagctgagctgcaagggcagatgcttcgagagcttcgagagaggcagagagtgcgactgcgacgcccagtgcaagaagtacgacaagtgctgccccgactacgagagcttctgcgccgaggtgcacaaccccaccagcccccccagcagcaagaaggcccccccccccagcggcgccagccagaccatcaagagcaccaccaagagaagccccaagccccccaacaagaagaagaccaagaaggtgatcgagagcgaggagatcaccgaggagcacagcgtgagcgagaaccaggagagcagcagcagcagcagcagcagcagcagcagcagcaccatcagaaagatcaagagcagcaagaacagcgccgccaacagagagctgcagaagaagctgaaggtgaaggacaacaagaagaacagaaccaagaagaagcccacccccaagccccccgtggtggacgaggccggcagcggcctggacaacggcgacttcaaggtgaccacccccgacaccagcaccacccagcacaacaaggtgagcaccagccccaagatcaccaccgccaagcccatcaaccccagacccagcctgccccccaacagcgacaccagcaaggagaccagcctgaccgtgaacaaggagaccaccgtggagaccaaggagaccaccaccaccaacaagcagaccagcaccgacggcaaggagaagaccaccagcgccaaggagacccagagcatcgagaagaccagcgccaaggacctggcccccaccagcaaggtgctggccaagcccacccccaaggccgagaccaccaccaagggccccgccctgaccacccccaaggagcccacccccaccacccccaaggagcccgccagcaccacccccaaggagcccacccccaccaccatcaagagcgcccccaccacccccaaggagcccgcccccaccaccaccaagagcgcccccaccacccccaaggagcccgcccccaccaccaccaaggagcccgcccccaccacccccaaggagcccgcccccaccaccaccaaggagcccgcccccaccaccaccaagagcgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccagccccaccacccccaaggagcccgcccccaccaccaccaagagcgcccccaccaccaccaaggagcccgcccccaccaccaccaagagcgcccccaccacccccaaggagcccagccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagctgacccccaccacccccgagaagctggcccccaccacccccgagaagcccgcccccaccacccccgaggagctggcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccaccctgaaggagcccgcccccaccacccccaagaagcccgcccccaaggagctggcccccaccaccaccaaggagcccaccagcaccacctgcgacaagcccgcccccaccacccccaagggcaccgcccccaccacccccaaggagcccgcccccaccacccccaaggagcccgcccccaccacccccaagggcaccgcccccaccaccctgaaggagcccgcccccaccacccccaagaagcccgcccccaaggagctggcccccaccaccaccaagggccccaccagcaccaccagcgacaagcccgcccccaccacccccaaggagaccgcccccaccacccccaaggagcccgcccccaccacccccaagaagcccgcccccaccacccccgagacccccccccccaccaccagcgaggtgagcacccccaccaccaccaaggagcccaccaccatccacaagagccccgacgagagcacccccgagctgagcgccgagcccacccccaaggccctggagaacagccccaaggagcccggcgtgcccaccaccaagacccccgccgccaccaagcccgagatgaccaccaccgccaaggacaagaccaccgagagagacctgagaaccacccccgagaccaccaccgccgcccccaagatgaccaaggagaccgccaccaccaccgagaagaccaccgagagcaagatcaccgccaccaccacccaggtgaccagcaccaccacccaggacaccacccccttcaagatcaccaccctgaagaccaccaccctggcccccaaggtgaccaccaccaagaagaccatcaccaccaccgagatcatgaacaagcccgaggagaccgccaagcccaaggacagagccaccaacagcaaggccaccacccccaagccccagaagcccaccaaggcccccaagaagcccaccagcaccaagaagcccaagaccatgcccagagtgagaaagcccaagaccacccccacccccagaaagatgaccagcaccatgcccgagctgaaccccaccagcagaatcgccgaggccatgctgcagaccaccaccagacccaaccagacccccaacagcaagctggtggaggtgaaccccaagagcgaggacgccggcggcgccgagggcgagaccccccacatgctgctgagaccccacgtgttcatgcccgaggtgacccccgacatggactacctgcccagagtgcccaaccagggcatcatcatcaaccccatgctgagcgacgagaccaacatctgcaacggcaagcccgtggacggcctgaccaccctgagaaacggcaccctggtggccttcagaggccactacttctggatgctgagccccttcagcccccccagccccgccagaagaatcaccgaggtgtggggcatccccagccccatcgacaccgtgttcaccagatgcaactgcgagggcaagaccttcttcttcaaggacagccagtactggagattcaccaacgacatcaaggacgccggctaccccaagcccatcttcaagggcttcggcggcctgaccggccagatcgtggccgccctgagcaccgccaagtacaagaactggcccgagagcgtgtacttcttcaagagaggcggcagcatccagcagtacatctacaagcaggagcccgtgcagaagtgccccggcagaagacccgccctgaactaccccgtgtacggcgagaccacccaggtgagaagaagaagattcgagagagccatcggccccagccagacccacaccatcagaatccagtacagccccgccagactggcctaccaggacaagggcgtgctgcacaacgaggtgaaggtgagcatcctgtggagaggcctgcccaacgtggtgaccagcgccatcagcctgcccaacatcagaaagcccgacggctacgactactacgccttcagcaaggaccagtactacaacatcgacgtgcccagcagaaccgccagagccatcaccaccagaagcggccagaccctgagcaaggtgtggtacaactgcccctag

SEQ ID NO: 95635 - DNA, 834 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccgtgaccggcggccagaagggcagaggcagcagaggccagcaccaggcccacagcctggagagagtgtgccactgcctgggcaagtggctgggccaccccgacaagttcgtgggcatcacctacgccctgaccgtggtgtggctgctggtgttcgcctgcagcgccgtgcccgtgtacatctacttcaacacctggaccacctgccagagcatcgccttccccagcaagaccagcgccagcatcggcagcctgtgcgccgacgccagaatgtacggcgtgctgccctggaacgccttccccggcaaggtgtgcggcagcaacctgctgagcatctgcaagaccgccgagttccagatgaccttccacctgttcatcgccgccttcgtgggcgccgccgccaccctggtgagcctgctgaccttcatgatcgccgccacctacaacttcgccgtgctgaagctgatgggcagaggcaccaagttctag

SEQ ID NO: 95636 - DNA, 729 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccttcgtgggcatcacctacgccctgaccgtggtgtggctgctggtgttcgcctgcagcgccgtgcccgtgtacatctacttcaacacctggaccacctgccagagcatcgccttccccagcaagaccagcgccagcatcggcagcctgtgcgccgacgccagaatgtacggcgtgctgccctggaacgccttccccggcaaggtgtgcggcagcaacctgctgagcatctgcaagaccgccgagttccagatgaccttccacctgttcatcgccgccttcgtgggcgccgccgccaccctggtgagcctgctgaccttcatgatcgccgccacctacaacttcgccgtgctgaagctgatgggcagaggcaccaagttctag

SEQ ID NO: 95637 - DNA, 834 bp, Artificial Sequence; identical to SEQ ID NO: 95635
  Description of Artificial Sequence: Synthetic coding sequence

SEQ ID NO: 95638 - DNA, 384 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccgtgaccggcggccagaagggcagaggcagcagatag

SEQ ID NO: 95639 - DNA, 768 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagaagggcagaggcagcagaggccagcaccaggcccacagcctggagagagtgtgccactgcctgggcaagtggctgggccaccccgacaagttcgtgggcatcacctacgccctgaccgtggtgtggctgctggtgttcgcctgcagcgccgtgcccgtgtacatctacttcaacacctggaccacctgccagagcatcgccttccccagcaagaccagcgccagcatcggcagcctgtgcgccgacgccagaatgtacggcgtgctgccctggaacgccttccccggcaaggtgtgcggcagcaacctgctgagcatctgcaagaccgccgagttccagatgaccttccacctgttcatcgccgccttcgtgggcgccgccgccaccctggtgagcctgctgaccttcatgatcgccgccacctacaacttcgccgtgctgaagctgatgggcagaggcaccaagttctag

SEQ ID NO: 95640 - DNA, 414 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccgtgaccggcggccagaagggcagaggcagcagaggccagcaccaggcccacagcctggagagatag

SEQ ID NO: 95641 - DNA, 303 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatctag

SEQ ID NO: 95642 - DNA, 372 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccgtgaccggcggccagaagggctag

SEQ ID NO: 95643 - DNA, 339 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggctag

SEQ ID NO: 95644 - DNA, 411 bp, Artificial Sequence
  Description of Artificial Sequence: Synthetic coding sequence
atgggcctgctggagtgctgcgccagatgcctggtgggcgcccccttcgccagcctggtggccaccggcctgtgcttcttcggcgtggccctgttctgcggctgcggccacgaggccctgaccggcaccgagaagctgatcgagacctacttcagcaagaactaccaggactacgagtacctgatcaacgtgatccacgccttccagtacgtgatctacggcaccgccagcttcttcttcctgtacggcgccctgctgctggccgagggcttctacaccaccggcgccgtgagacagatcttcggcgactacaagaccaccatctgcggcaagggcctgagcgccaccgtgaccggcggccagaagggcagaggcagcagaggccagcaccaggcccacagcctggagtag

SEQ ID NO: 95645 - DNA, 438 bp, Artificial Sequence
  Description of Artificial Sequence: Synthetic coding sequence
atggccgacagcgagagactgagcgcccccggctgctgggccgcctgcaccaacttcagcagaaccagaaagggcatcctgctgttcgccgagatcatcctgtgcctggtgatcctgatctgcttcagcgccagcacccccggctacagcagcctgagcgtgatcgagatgatcctggccgccatcttcttcgtggtgtacatgtgcgacctgcacaccaagatccccttcatcaactggccctggagcgacttcttcagaaccctgatcgccgccatcctgtacctgatcaccagcatcgtggtgctggtggagagaggcaaccacagcaagatcgtggccggcgtgaaggccatgggcgccgccctgaagcacagagccaagggcctgagaagccagggccccttcctgcccctgctgctggccgagatcgtgtag

SEQ ID NO: 95646 - DNA, 459 bp, Artificial Sequence
  Description of Artificial Sequence: Synthetic coding sequence
atggccgacagcgagagactgagcgcccccggctgctgggccgcctgcaccaacttcagcagaaccagaaagggcatcctgctgttcgccgagatcatcctgtgcctggtgatcctgatctgcttcagcgccagcacccccggctacagcagcctgagcgtgatcgagatgatcctggccgccatcttcttcgtggtgtacatgtgcgacctgcacaccaagatccccttcatcaactggccctggagcgacttcttcagaaccctgatcgccgccatcctgtacctgatcaccagcatcgtggtgctggtggagagaggcaaccacagcaagatcgtggccggcgtgctgggcctgatcgccacctgcctgttcggctacgacgcctacgtgaccttccccgtgagacagcccagacacaccgccgcccccaccgaccccgccgacggccccgtgtag

SEQ ID NO: 95647 - DNA, 336 bp, Artificial Sequence
  Description of Artificial Sequence: Synthetic coding sequence
atgagcgacgccgccgtggacaccagcagcgagatcaccaccaaggacctgaaggagaagaaggaggtggtggaggaggccgagaacggcagagacgcccccgccaacggcaacgccgagaacgaggagaacggcgagcaggaggccgacaacgaggtggacgaggaggaggaggagggcggcgaggaggaggaggaggaggaggagggcgacggcgaggaggaggacggcgacgaggacgaggaggccgagagcgccaccggcaagagagccgccgaggacgacgaggacgacgacgtggacaccaagaagcagaagaccgacgaggacgactag

SEQ ID NO: 95648 - DNA, 408 bp, Artificial Sequence
  Description of Artificial Sequence: Synthetic coding sequence
atgcagaccttcggccccgccggcgtggccgccgtgggcagaagagtggagagccccgccgacagaagagccaccagagcctgccactgcaagctgtgcctgcccgccggcagcctgcagggcctgaagggcgaggagggcagcgtggaggaggccgagaacggcagagacgcccccgccaacggcaacgccaacgaggagaacggcgagcaggaggccgacaacgaggtggacgaggaggaggaggagggcggcgaggaggaggaggaggaggaggagggcgacggcgaggaggaggacggcgacgaggacgaggaggccgagagcgccaccggcaagagagccgccgaggacgacgaggacgacgacgtggacaccaagaagcagaagaccgacgaggacgactag

SEQ ID NO: 95649 - DNA, 333 bp, Artificial Sequence
  Description of Artificial Sequence: Synthetic coding sequence
atgagcgacgccgccgtggacaccagcagcgagatcaccaccaaggacctgaaggagaagaaggaggtggtggaggaggccgagaacggcagagacgcccccgccaacggcaacgccaacgaggagaacggcgagcaggaggccgacaacgaggtggacgaggaggaggaggagggcggcgaggaggaggaggaggaggaggagggcgacggcgaggaggaggacggcgacgaggacgaggaggccgagagcgccaccggcaagagagccgccgaggacgacgaggacgacgacgtggacaccaagaagcagaagaccgacgaggacgactag

SEQ ID NO: 95650 - DNA, 3714 bp, Artificial Sequence
  Description of Artificial Sequence: Synthetic coding sequence
atggacagcggcgccggcggcagaagatgccccgaggccgccctgctgatcctgggcccccccagaatggagcacctgagacacagccccggccccggcggccagagactgctgctgcccagcatgctgctggccctgctgctgctgctggcccccagccccggccacgccaccagagtggtgtacaaggtgcccgaggagcagccccccaacaccctgatcggcagcctggccgccgactacggcttccccgacgtgggccacctgtacaagctggaggtgggcgccccctacctgagagtggacggcaagaccggcgacatcttcaccaccgagaccagcatcgacagagagggcctgagagagtgccagaaccagctgcccggcgacccctgcatcctggagttcgaggtgagcatcaccgacctggtgcagaacggcagccccagactgctggagggccagatcgaggtgcaggacatcaacgacaacacccccaacttcgccagccccgtgatcaccctggccatccccgagaacaccaacatcggcagcctgttccccatccccctggccagcgacagagacgccggccccaacggcgtggccagctacgagctgcaggccggccccgaggcccaggagctgttcggcctgcaggtggccgaggaccaggaggagaagcagccccagctgatcgtgatgggcaacctggacagagagagatgggacagctacgacctgaccatcaaggtgcaggacggcggcagcccccccagagccagcagcgccctgctgagagtgaccgtgctggacaccaacgacaacgcccccaagttcgagagacccagctacgaggccgagctgagcgagaacagccccatcggccacagcgtgatccaggtgaaggccaacgacagcgaccagggcgccaacgccgagatcgagtacaccttccaccaggcccccgaggtggtgagaagactgctgagactggacagaaacaccggcctgatcaccgtgcagggccccgtggacagagaggacctgagcaccctgagattcagcgtgctggccaaggacagaggcaccaaccccaagagcgccagagcccaggtggtggtgaccgtgaaggacatgaacgacaacgcccccaccatcgagatcagaggcatcggcctggtgacccaccaggacggcatggccaacatcagcgaggacgtggccgaggagaccgccgtggccctggtgcaggtgagcgacagagacgagggcgagaacgccgccgtgacctgcgtggtggccggcgacgtgcccttccagctgagacaggccagcgagaccggcagcgacagcaagaagaagtacttcctgcagaccaccacccccctggactacgagaaggtgaaggactacaccatcgagatcgtggccgtggacagcggcaacccccccctgagcagcaccaacagcctgaaggtgcaggtggtggacgtgaacgacaacgcccccgtgttcacccagagcgtgaccgaggtggccttccccgagaacaacaagcccggcgaggtgatcgccgagatcaccgccagcgacgccgacagcggcagcaacgccgagctggtgtacagcctggagcccgagcccgccgccaagggcctgttcaccatcagccccgagaccggcgagatccaggtgaagaccagcctggacagagagcagagagagagctacgagctgaaggtggtggccgccgacagaggcagccccagcctgcagggcaccgccaccgtgctggtgaacgtgctggactgcaacgacaacgaccccaagttcatgctgagcggctacaacttcagcgtgatggagaacatgcccgccctgagccccgtgggcatggtgaccgtgatcgacggcgacaagggcgagaacgcccaggtgcagctgagcgtggagcaggacaacggcgacttcgtgatccagaacggcaccggcaccatcctgagcagcctgagcttcgacagagagcagcagagcacctacaccttccagctgaaggccgtggacggcggcgtgccccccagaagcgcctacgtgggcgtgaccatcaacgtgctggacgagaacgacaacgccccctacatcaccgcccccagcaacaccagccacaagctgctgaccccccagaccagactgggcgagaccgtgagccaggtggccgccgaggacttcgacagcggcgtgaacgccgagctgatctacagcatcgccggcggcaacccctacggcctgttccagatcggcagccacagcggcgccatcaccctggagaaggagatcgagagaagacaccacggcctgcacagactggtggtgaaggtgagcgacagaggcaagccccccagatacggcaccgccctggtgcacctgtacgtgaacgagaccctggccaacagaaccctgctggagaccctgctgggccacagcctggacacccccctggacatcgacatcgccggcgaccccgagtacgagagaagcaagcagagaggcaacatcctgttcggcgtggtggccggcgtggtggccgtggccctgctgatcgccctggccgtgctggtgagatactgcagacagagagaggccaagagcggctaccaggccggcaagaaggagaccaaggacctgtacgcccccaagcccagcggcaaggccagcaagggcaacaagagcaagggcaagaagagcaagagccccaagcccgtgaagcccgtggaggacgaggacgaggccggcctgcagaagagcctgaagttcaacctgatgagcgacgcccccggcgacagccccagaatccacctgcccctgaactacccccccggcagccccgacctgggcagacactacagaagcaacagccccctgcccagcatccagctgcagccccagagccccagcgccagcaagaagcaccaggtggtgcaggacctgccccccgccaacaccttcgtgggcaccggcgacaccaccagcaccggcagcgagcagtacagcgactacagctacagaaccaacccccccaagtaccccagcaagcagctgccccacagaagagtgaccttcagcgccaccagccaggcccaggagctgcaggaccccagccagcacagctactacgacagcggcctggaggagagcgagacccccagcagcaagagcagcagcggccccagactgggccccctggccctgcccgaggaccactacgagagaaccacccccgacggcagcatcggcgagatggagcaccccgagaacgacctgagacccctgcccgacgtggccatgaccggcacctgcaccagagagtgcagcgagttcggccacagcgacacctgctggatgcccggccagagcagccccagcagaagaaccaagagcagcgccctgaagctgagcaccttcgtgccctaccaggacagaggcggccaggagcccgccggcgccggcagccccagcccccccgaggacagaaacaccaagaccgcccccgtgagactgctgcccagctacagcgccttcagccacagcagccacgacagctgcaaggacagcgccaccctggaggagatccccctgacccagaccagcgacttcccccccgccgccacccccgccagcgcccagaccgccaagagagagatctacctgtag

SEQ ID NO: 95651 - DNA, 3183 bp, Artificial Sequence
  Description of Artificial Sequence: Synthetic coding sequence
atggacagcggcgccggcggcagaagatgccccgaggccgccctgctgatcctgggcccccccagaatggagcacctgagacacagccccggccccggcggccagagactgctgctgcccagcatgctgctggccctgctgctgctgctggcccccagccccggccacgccaccagagtggtgtacaaggtgcccgaggagcagccccccaacaccctgatcggcagcctggccgccgactacggcttccccgacgtgggccacctgtacaagctggaggtgggcgccccctacctgagagtggacggcaagaccggcgacatcttcaccaccgagaccagcatcgacagagagggcctgagagagtgccagaaccagctgcccggcgacccctgcatcctggagttcgaggtgagcatcaccgacctggtgcagaacggcagccccagactgctggagggccagatcgaggtgcaggacatcaacgacaacacccccaacttcgccagccccgtgatcaccctggccatccccgagaacaccaacatcggcagcctgttccccatccccctggccagcgacagagacgccggccccaacggcgtggccagctacgagctgcaggccggccccgaggcccaggagctgttcggcctgcaggtggccgaggaccaggaggagaagcagccccagctgatcgtgatgggcaacctggacagagagagatgggacagctacgacctgaccatcaaggtgcaggacggcggcagcccccccagagccagcagcgccctgctgagagtgaccgtgctggacaccaacgacaacgcccccaagttcgagagacccagctacgaggccgagctgagcgagaacagccccatcggccacagcgtgatccaggtgaaggccaacgacagcgaccagggcgccaacgccgagatcgagtacaccttccaccaggcccccgaggtggtgagaagactgctgagactggacagaaacaccggcctgatcaccgtgcagggccccgtggacagagaggacctgagcaccctgagattcagcgtgctggccaaggacagaggcaccaaccccaagagcgccagagcccaggtggtggtgaccgtgaaggacatgaacgacaacgcccccaccatcgagatcagaggcatcggcctggtgacccaccaggacggcatggccaacatcagcgaggacgtggccgaggagaccgccgtggccctggtgcaggtgagcgacagagacgagggcgagaacgccgccgtgacctgcgtggtggccggcgacgtgcccttccagctgagacaggccagcgagaccggcagcgacagcaagaagaagtacttcctgcagaccaccacccccctggactacgagaaggtgaaggactacaccatcgagatcgtggccgtggacagcggcaacccccccctgagcagcaccaacagcctgaaggtgcaggtggtggacgtgaacgacaacgcccccgtgttcacccagagcgtgaccgaggtggccttccccgagaacaacaagcccggcgaggtgatcgccgagatcaccgccagcgacgccgacagcggcagcaacgccgagctggtgtacagcctggagcccgagcccgccgccaagggcctgttcaccatcagccccgagaccggcgagatccaggtgaagaccagcctggacagagagcagagagagagctacgagctgaaggtggtggccgccgacagaggcagccccagcctgcagggcaccgccaccgtgctggtgaacgtgctggactgcaacgacaacgaccccaagttcatgctgagcggctacaacttcagcgtgatggagaacatgcccgccctgagccccgtgggcatggtgaccgtgatcgacggcgacaagggcgagaacgcccaggtgcagctgagcgtggagcaggacaacggcgacttcgtgatccagaacggcaccggcaccatcctgagcagcctgagcttcgacagagagcagcagagcacctacaccttccagctgaaggccgtggacggcggcgtgccccccagaagcgcctacgtgggcgtgaccatcaacgtgctggacgagaacgacaacgccccctacatcaccgcccccagcaacaccagccacaagctgctgaccccccagaccagactgggcgagaccgtgagccaggtggccgccgaggacttcgacagcggcgtgaacgccgagctgatctacagcatcgccggcggcaacccctacggcctgttccagatcggcagccacagcggcgccatcaccctggagaaggagatcgagagaagacaccacggcctgcacagactggtggtgaaggtgagcgacagaggcaagccccccagatacggcaccgccctggtgcacctgtacgtgaacgagaccctggccaacagaaccctgctggagaccctgctgggccacagcctggacacccccctggacatcgacatcgccggcgaccccgagtacgagagaagcaagcagagaggcaacatcctgttcggcgtggtggccggcgtggtggccgtggccctgctgatcgccctggccgtgctggtgagatactgcagacagagagaggccaagagcggctaccaggccggcaagaaggagaccaaggacctgtacgcccccaagcccagcggcaaggccagcaagggcaacaagagcaagggcaagaagagcaagagccccaagcccgtgaagcccgtggaggacgaggacgaggccggcctgcagaagagcctgaagttcaacctgatgagcgacgcccccggcgacagccccagaatccacctgcccctgaactacccccccggcagccccgacctgggcagacactacagaagcaacagccccctgcccagcatccagctgcagccccagagccccagcgccagcaagaagcaccaggtggtgcaggacctgccccccgccaacaccttcgtgggcaccggcgacaccaccagcaccggcagcgagcagtacagcgactacagctacagaaccaacccccccaagtaccccagcaagcaggtgggccagcccttccagctgagcaccccccagcccctgccccacccctaccacggcgccatctggaccgaggtgtgggagtag

SEQ ID NO: 95652 - DNA, 3147 bp, Artificial Sequence
  Description of Artificial Sequence: Synthetic coding sequence
atggacagcggcgccggcggcagaagatgccccgaggccgccctgctgatcctgggcccccccagaatggagcacctgagacacagccccggccccggcggccagagactgctgctgcccagcatgctgctggccctgctgctgctgctggcccccagccccggccacgccaccagagtggtgtacaaggtgcccgaggagcagccccccaacaccctgatcggcagcctggccgccgactacggcttccccgacgtgggccacctgtacaagctggaggtgggcgccccctacctgagagtggacggcaagaccggcgacatcttcaccaccgagaccagcatcgacagagagggcctgagagagtgccagaaccagctgcccggcgacccctgcatcctggagttcgaggtgagcatcaccgacctggtgcagaacggcagccccagactgctggagggccagatcgaggtgcaggacatcaacgacaacacccccaacttcgccagccccgtgatcaccctggccatccccgagaacaccaacatcggcagcctgttccccatccccctggccagcgacagagacgccggccccaacggcgtggccagctacgagctgcaggtggccgaggaccaggaggagaagcagccccagctgatcgtgatgggcaacctggacagagagagatgggacagctacgacctgaccatcaaggtgcaggacggcggcagcccccccagagccagcagcgccctgctgagagtgaccgtgctggacaccaacgacaacgcccccaagttcgagagacccagctacgaggccgagctgagcgagaacagccccatcggccacagcgtgatccaggtgaaggccaacgacagcgaccagggcgccaacgccgagatcgagtacaccttccaccaggcccccgaggtggtgagaagactgctgagactggacagaaacaccggcctgatcaccgtgcagggccccgtggacagagaggacctgagcaccctgagattcagcgtgctggccaaggacagaggcaccaaccccaagagcgccagagcccaggtggtggtgaccgtgaaggacatgaacgacaacgcccccaccatcgagatcagaggcatcggcctggtgacccaccaggacggcatggccaacatcagcgaggacgtggccgaggagaccgccgtggccctggtgcaggtgagcgacagagacgagggcgagaacgccgccgtgacctgcgtggtggccggcgacgtgcccttccagctgagacaggccagcgagaccggcagcgacagcaagaagaagtacttcctgcagaccaccacccccctggactacgagaaggtgaaggactacaccatcgagatcgtggccgtggacagcggcaacccccccctgagcagcaccaacagcctgaaggtgcaggtggtggacgtgaacgacaacgcccccgtgttcacccagagcgtgaccgaggtggccttccccgagaacaacaagcccggcgaggtgatcgccgagatcaccgccagcgacgccgacagcggcagcaacgccgagctggtgtacagcctggagcccgagcccgccgccaagggcctgttcaccatcagccccgagaccggcgagatccaggtgaagaccagcctggacagagagcagagagagagctacgagctgaaggtggtggccgccgacagaggcagccccagcctgcagggcaccgccaccgtgctggtgaacgtgctggactgcaacgacaacgaccccaagttcatgctgagcggctacaacttcagcgtgatggagaacatgcccgccctgagccccgtgggcatggtgaccgtgatcgacggcgacaagggcgagaacgcccaggtgcagctgagcgtggagcaggacaacggcgacttcgtgatccagaacggcaccggcaccatcctgagcagcctgagcttcgacagagagcagcagagcacctacaccttccagctgaaggccgtggacggcggcgtgccccccagaagcgcctacgtgggcgtgaccatcaacgtgctggacgagaacgacaacgccccctacatcaccgcccccagcaacaccagccacaagctgctgaccccccagaccagactgggcgagaccgtgagccaggtggccgccgaggacttcgacagcggcgtgaacgccgagctgatctacagcatcgccggcggcaacccctacggcctgttccagatcggcagccacagcggcgccatcaccctggagaaggagatcgagagaagacaccacggcctgcacagactggtggtgaaggtgagcgacagaggcaagccccccagatacggcaccgccctggtgcacctgtacgtgaacgagaccctggccaacagaaccctgctggagaccctgctgggccacagcctggacacccccctggacatcgacatcgccggcgaccccgagtacgagagaagcaagcagagaggcaacatcctgttcggcgtggtggccggcgtggtggccgtggccctgctgatcgccctggccgtgctggtgagatactgcagacagagagaggccaagagcggctaccaggccggcaagaaggagaccaaggacctgtacgcccccaagcccagcggcaaggccagcaagggcaacaagagcaagggcaagaagagcaagagccccaagcccgtgaagcccgtggaggacgaggacgaggccggcctgcagaagagcctgaagttcaacctgatgagcgacgcccccggcgacagccccagaatccacctgcccctgaactacccccccggcagccccgacctgggcagacactacagaagcaacagccccctgcccagcatccagctgcagccccagagccccagcgccagcaagaagcaccaggtggtgcaggacctgccccccgccaacaccttcgtgggcaccggcgacaccaccagcaccggcagcgagcagtacagcgactacagctacagaaccaacccccccaagtaccccagcaagcaggtgggccagcccttccagctgagcaccccccagcccctgccccacccctaccacggcgccatctggaccgaggtgtgggagtag

SEQ ID NO: 95653 - DNA, 3117 bp, Artificial Sequence
  Description of Artificial Sequence: Synthetic coding sequence
atggagcacctgagacacagccccggccccggcggccagagactgctgctgcccagcatgctgctggccctgctgctgctgctggcccccagccccggccacgccaccagagtggtgtacaaggtgcccgaggagcagccccccaacaccctgatcggcagcctggccgccgactacggcttccccgacgtgggccacctgtacaagctggaggtgggcgccccctacctgagagtggacggcaagaccggcgacatcttcaccaccgagaccagcatcgacagagagggcctgagagagtgccagaaccagctgcccggcgacccctgcatcctggagttcgaggtgagcatcaccgacctggtgcagaacggcagccccagactgctggagggccagatcgaggtgcaggacatcaacgacaacacccccaacttcgccagccccgtgatcaccctggccatccccgagaacaccaacatcggcagcctgttccccatccccctggccagcgacagagacgccggccccaacggcgtggccagctacgagctgcaggccggccccgaggcccaggagctgttcggcctgcaggtggccgaggaccaggaggagaagcagccccagctgatcgtgatgggcaacctggacagagagagatgggacagctacgacctgaccatcaaggtgcaggacggcggcagcccccccagagccagcagcgccctgctgagagtgaccgtgctggacaccaacgacaacgcccccaagttcgagagacccagctacgaggccgagctgagcgagaacagccccatcggccacagcgtgatccaggtgaaggccaacgacagcgaccagggcgccaacgccgagatcgagtacaccttccaccaggcccccgaggtggtgagaagactgctgagactggacagaaacaccggcctgatcaccgtgcagggccccgtggacagagaggacctgagcaccctgagattcagcgtgctggccaaggacagaggcaccaaccccaagagcgccagagcccaggtggtggtgaccgtgaaggacatgaacgacaacgcccccaccatcgagatcagaggcatcggcctggtgacccaccaggacggcatggccaacatcagcgaggacgtggccgaggagaccgccgtggccctggtgcaggtgagcgacagagacgagggcgagaacgccgccgtgacctgcgtggtggccggcgacgtgcccttccagctgagacaggccagcgagaccggcagcgacagcaagaagaagtacttcctgcagaccaccacccccctggactacgagaaggtgaaggactacaccatcgagatcgtggccgtggacagcggcaacccccccctgagcagcaccaacagcctgaaggtgcaggtggtggacgtgaacgacaacgcccccgtgttcacccagagcgtgaccgaggtggccttccccgagaacaacaagcccggcgaggtgatcgccgagatcaccgccagcgacgccgacagcggcagcaacgccgagctggtgtacagcctggagcccgagcccgccgccaagggcctgttcaccatcagccccgagaccggcgagatccaggtgaagaccagcctggacagagagcagagagagagctacgagctgaaggtggtggccgccgacagaggcagccccagcctgcagggcaccgccaccgtgctggtgaacgtgctggactgcaacgacaacgaccccaagttcatgctgagcggctacaacttcagcgtgatggagaacatgcccgccctgagccccgtgggcatggtgaccgtgatcgacggcgacaagggcgagaacgcccaggtgcagctgagcgtggagcaggacaacggcgacttcgtgatccagaacggcaccggcaccatcctgagcagcctgagcttcgacagagagcagcagagcacctacaccttccagctgaaggccgtggacggcggcgtgccccccagaagcgcctacgtgggcgtgaccatcaacgtgctggacgagaacgacaacgccccctacatcaccgcccccagcaacaccagccacaagctgctgaccccccagaccagactgggcgagaccgtgagccaggtggccgccgaggacttcgacagcggcgtgaacgccgagctgatctacagcatcgccggcggcaacccctacggcctgttccagatcggcagccacagcggcgccatcaccctggagaaggagatcgagagaagacaccacggcctgcacagactggtggtgaaggtgagcgacagaggcaagccccccagatacggcaccgccctggtgcacctgtacgtgaacgagaccctggccaacagaaccctgctggagaccctgctgggccacagcctggacacccccctggacatcgacatcgccggcgaccccgagtacgagagaagcaagcagagaggcaacatcctgttcggcgtggtggccggcgtggtggccgtggccctgctgatcgccctggccgtgctggtgagatactgcagacagagagaggccaagagcggctaccaggccggcaagaaggagaccaaggacctgtacgcccccaagcccagcggcaaggccagcaagggcaacaagagcaagggcaagaagagcaagagccccaagcccgtgaagcccgtggaggacgaggacgaggccggcctgcagaagagcctgaagttcaacctgatgagcgacgcccccggcgacagccccagaatccacctgcccctgaactacccccccggcagccccgacctgggcagacactacagaagcaacagccccctgcccagcatccagctgcagccccagagccccagcgccagcaagaagcaccaggtggtgcaggacctgccccccgccaacaccttcgtgggcaccggcgacaccaccagcaccggcagcgagcagtacagcgactacagctacagaaccaacccccccaagtaccccagcaagcaggtgggccagcccttccagctgagcaccccccagcccctgccccacccctaccacggcgccatctggaccgaggtgtgggagtag

SEQ ID NO: 95654 - DNA, 3123 bp, Artificial Sequence
  Description of Artificial Sequence: Synthetic coding sequence
atgatcgtgctgctgctgttcgccctgctgtggatggtggagggcgtgttcagccagctgcactacaccgtgcaggaggagcaggagcacggcaccttcgtgggcaacatcgccgaggacctgggcctggacatcaccaagctgagcgccagaggcttccagaccgtgcccaacagcagaaccccctacctggacctgaacctggagaccggcgtgctgtacgtgaacgagaagatcgacagagagcagatctgcaagcagagccccagctgcgtgctgcacctggaggtgttcctggagaaccccctggagctgttccaggtggagatcgaggtgctggacatcaacgacaacccccccagcttccccgagcccgacctgaccgtggagatcagcgagagcgccacccccggcaccagattccccctggagagcgccttcgaccccgacgtgggcaccaacagcctgagagactacgagatcacccccaacagctacttcagcctggacgtgcagacccagggcgacggcaacagattcgccgagctggtgctggagaagcccctggacagagagcagcaggccgtgcacagatacgtgctgaccgccgtggacggcggcggcggcggcggcgtgggcgagggcggcggcggcggcggcggcgccggcctgcccccccagcagcagagaaccggcaccgccctgctgaccatcagagtgctggacagcaacgacaacgtgcccgccttcgaccagcccgtgtacaccgtgagcctgcccgagaacagcccccccggcaccctggtgatccagctgaacgccaccgaccccgacgagggccagaacggcgaggtggtgtacagcttcagcagccacatcagccccagagccagagagctgttcggcctgagccccagaaccggcagactggaggtgagcggcgagctggactacgaggagagccccgtgtaccaggtgtacgtgcaggccaaggacctgggccccaacgccgtgcccgcccactgcaaggtgctggtgagagtgctggacgccaacgacaacgcccccgagatcagcttcagcaccgtgaaggaggccgtgagcgagggcgccgcccccggcaccgtggtggccctgttcagcgtgaccgacagagacagcgaggagaacggccaggtgcagtgcgagctgctgggcgacgtgcccttcagactgaagagcagcttcaagaactactacaccatcgtgaccgaggcccccctggacagagaggccggcgacagctacaccctgaccgtggtggccagagacagaggcgagcccgccctgagcaccagcaagagcatccaggtgcaggtgagcgacgtgaacgacaacgcccccagattcagccagcccgtgtacgacgtgtacgtgaccgagaacaacgtgcccggcgcctacatctacgccgtgagcgccaccgacagagacgagggcgccaacgcccagctggcctacagcatcctggagtgccagatccagggcatgagcgtgttcacctacgtgagcatcaacagcgagaacggctacctgtacgccctgagaagcttcgactacgagcagctgaaggacttcagcttccaggtggaggccagagacgccggcagcccccaggccctggccggcaacgccaccgtgaacatcctgatcgtggaccagaacgacaacgcccccgccatcgtggcccccctgcccggcagaaacggcacccccgccagagaggtgctgcccagaagcgccgagcccggctacctgctgaccagagtggccgccgtggacgccgacgacggcgagaacgccagactgacctacagcatcgtgagaggcaacgagatgaacctgttcagaatggactggagaaccggcgagctgagaaccgccagaagagtgcccgccaagagagacccccagagaccctacgagctggtgatcgaggtgagagaccacggccagccccccctgagcagcaccgccaccctggtggtgcagctggtggacggcgccgtggagccccagggcggcggcggcagcggcggcggcggcagcggcgagcaccagagacccagcagaagcggcggcggcgagaccagcctggacctgaccctgatcctgatcatcgccctgggcagcgtgagcttcatcttcctgctggccatgatcgtgctggccgtgagatgccagaaggagaagaagctgaacatctacacctgcctggccagcgactgctgcctgtgctgctgctgctgcggcggcggcggcagcacctgctgcggcagacaggccagagccagaaagaagaagctgagcaagagcgacatcatgctggtgcagagcagcaacgtgcccagcaaccccgcccaggtgcccatcgaggagagcggcggcttcggcagccaccaccacaaccagaactactgctaccaggtgtgcctgacccccgagagcgccaagaccgacctgatgttcctgaagccctgcagccccagcagaagcaccgacaccgagcacaacccctgcggcgccatcgtgaccggctacaccgaccagcagcccgacatcatcagcaacggcagcatcctgagcaacgagaccaagcaccagagagccgagctgagctacctggtggacagacccagaagagtgaacagcagcgccttccaggaggccgacatcgtgagcagcaaggacagcggccacggcgacagcgagcagggcgacagcgaccacgacgccaccaacagagcccagagcgccggcatggacctgttcagcaactgcaccgaggagtgcaaggccctgggccacagcgacagatgctggatgcccagcttcgtgcccagcgacggcagacaggccgccgactacagaagcaacctgcacgtgcccggcatggacagcgtgcccgacaccgaggtgttcgagacccccgaggcccagcccggcgccgagagaagcttcagcaccttcggcaaggagaaggccctgcacagcaccctggagagaaaggagctggacggcctgctgaccaacaccagagccccctacaagcccccctacctgaccagaaagagaatctgctag

SEQ ID NO: 95655 - DNA, 3123 bp, Artificial Sequence
  Description of Artificial Sequence: Synthetic coding sequence
atgatcgtgctgctgctgttcgccctgctgtggatggtggagggcgtgttcagccagctgcactacaccgtgcaggaggagcaggagcacggcaccttcgtgggcaacatcgccgaggacctgggcctggacatcaccaagctgagcgccagaggcttccagaccgtgcccaacagcagaaccccctacctggacctgaacctggagaccggcgtgctgtacgtgaacgagaagatcgacagagagcagatctgcaagcagagccccagctgcgtgctgcacctggaggtgttcctggagaaccccctggagctgttccaggtggagatcgaggtgctggacatcaacgacaacccccccagcttccccgagcccgacctgaccgtggagatcagcgagagcgccacccccggcaccagattccccctggagagcgccttcgaccccgacgtgggcaccaacagcctgagagactacgagatcacccccaacagctacttcagcctggacgtgcagacccagggcgacggcaacagattcgccgagctggtgctggagaagcccctggacagagagcagcaggccgtgcacagatacgtgctgaccgccgtggacggcggcggcggcggcggcgtgggcgagggcggcggcggcggcggcggcgccggcctgcccccccagcagcagagaaccggcaccgccctgctgaccatcagagtgctggacagcaacgacaacgtgcccgccttcgaccagcccgtgtacaccgtgagcctgcccgagaacagcccccccggcaccctggtgatccagctgaacgccaccgaccccgacgagggccagaacggcgaggtggtgtacagcttcagcagccacatcagccccagagccagagagctgttcggcctgagccccagaaccggcagactggaggtgagcggcgagctggactacgaggagagccccgtgtaccaggtgtacgtgcaggccaaggacctgggccccaacgccgtgcccgcccactgcaaggtgctggtgagagtgctggacgccaacgacaacgcccccgagatcagcttcagcaccgtgaaggaggccgtgagcgagggcgccgcccccggcaccgtggtggccctgttcagcgtgaccgacagagacagcgaggagaacggccaggtgcagtgcgagctgctgggcgacgtgcccttcagactgaagagcagcttcaagaactactacaccatcgtgaccgaggcccccctggacagagaggccggcgacagctacaccctgaccgtggtggccagagacagaggcgagcccgccctgagcaccagcaagagcatccaggtgcaggtgagcgacgtgaacgacaacgcccccagattcagccagcccgtgtacgacgtgtacgtgaccgagaacaacgtgcccggcgcctacatctacgccgtgagcgccaccgacagagacgagggcgccaacgcccagctggcctacagcatcctggagtgccagatccagggcatgagcgtgttcacctacgtgagcatcaacagcgagaacggctacctgtacgccctgagaagcttcgactacgagcagctgaaggacttcagcttccaggtggaggccagagacgccggcagcccccaggccctggccggcaacgccaccgtgaacatcctgatcgtggaccagaacgacaacgcccccgccatcgtggcccccctgcccggcagaaacggcacccccgccagagaggtgctgcccagaagcgccgagcccggctacctgctgaccagagtggccgccgtggacgccgacgacggcgagaacgccagactgacctacagcatcgtgagaggcaacgagatgaacctgttcagaatggactggagaaccggcgagctgagaaccgccagaagagtgcccgccaagagagacccccagagaccctacgagctggtgatcgaggtgagagaccacggccagccccccctgagcagcaccgccaccctggtggtgcagctggtggacggcgccgtggagccccagggcggcggcggcagcggcggcggcggcagcggcgagcaccagagacccagcagaagcggcggcggcgagaccagcctggacctgaccctgatcctgatcatcgccctgggcagcgtgagcttcatcttcctgctggccatgatcgtgctggccgtgagatgccagaaggagaagaagctgaacatctacacctgcctggccagcgactgctgcctgtgctgctgctgctgcggcggcggcggcagcacctgctgcggcagacaggccagagccagaaagaagaagctgagcaagagcgacatcatgctggtgcagagcagcaacgtgcccagcaaccccgcccaggtgcccatcgaggagagcggcggcttcggcagccaccaccacaaccagaactactgctaccaggtgtgcctgacccccgagagcgccaagaccgacctgatgttcctgaagccctgcagccccagcagaagcaccgacaccgagcacaacccctgcggcgccatcgtgaccggctacaccgaccagcagcccgacatcatcagcaacggcagcatcctgagcaacgagaccaagcaccagagagccgagctgagctacctggtggacagacccagaagagtgaacagcagcgccttccaggaggccgacatcgtgagcagcaaggacagcggccacggcgacagcgagcagggcgacagcgaccacgacgccaccaacagagcccagagcgccggcatggacctgttcagcaactgcaccgaggagtgcaaggccctgggccacagcgacagatgctggatgcccagcttcgtgcccagcgacggcagacaggccgccgactacagaagcaacctgcacgtgcccggcatggacagcgtgcccgacaccgaggtgttcgagacccccgaggcccagcccggcgccgagagaagcttcagcaccttcggcaaggagaaggccctgcacagcaccctggagagaaaggagctggacggcctgctgaccaacaccagagccccctacaagcccccctacctgagaaagaagcagagatgctag

SEQ ID NO: 95656 - DNA, 3933 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagacccagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccagaagccccaccgccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95657 - DNA, 4044 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagaaagagcgagggcaaggtggccggcaagagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccagaagccccaccgccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95658 - DNA, 3990 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95659 - DNA, 3066 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagacccgtgggcatccaggtgagcaacaccaccttctag

SEQ ID NO: 95660 - DNA, 3933 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagacccagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccggcctgaagaaggccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95661 - DNA, 4044 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagaaagagcgagggcaaggtggccggcaagagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccggcctgaagaaggccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95662 - DNA, 4014 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccggcctgaagaaggccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95663 - DNA, 3078 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagacccaccgacagcagaaccagcaccatcgagatctgcagcgagatctag

SEQ ID NO: 95664 - DNA, 4020 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagaaagagcgagggcaaggtggccggcaagagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccgccgagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagccccagagtgacccagaccatcgccctgtgccacagcccccccgtgacccagaccatcgccctgtgccacagccccccccccatccaggtgagcgccctgcaccacagcccccccctggtgcaggccaccgccctgcaccacagcccccccagcgcccaggccagcgccctgtgctacagcccccccctggcccaggccgccgccatcagccacagcagccccctgccccaggtgatcgccctgcacagaagccaggcccagagcagcgtgagcctgcagcagggctgggtgcagggcgccgacggcctgtgcagcgtggaccagggcgtgcagggcagcgccaccagccagttctacaccatgagcgagagactgcaccccagcgacgacagcatcaaggtgatccccctgaccaccttcacccccagacagcaggccagacccagcagaggcgacagccccatcatggaggagcaccccctgtag

SEQ ID NO: 95665 - DNA, 3198 bp, Artificial Sequence
  Description of Artificial Sequence: Synthetic coding sequence
atggacctgctgagcggcacctacatcttcgccgtgctgctggcctgcgtggtgttccacagcggcgcccaggagaagaactacaccatcagagaggagatgcccgagaacgtgctgatcggcgacctgctgaaggacctgaacctgagcctgatccccaacaagagcctgaccaccgccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaccgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgaccaaggtgagcgccatggacgccgacagcggccccaacgccaagatcaactacctgctgggccccgacgccccccccgagttcagcctggactgcagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaacttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgccccccagcaactgcagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcaccgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacaagcagaacagcgagtgggccacccccaaccccgagaacagacagatgatcatgatgaagaagaagaagaagaagaagaagcacagccccaagaacctgctgctgaacttcgtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacagcaagcaccacatcatccaggagctgcccctggacaacaccttcgtggcctgcgacagcatcagcaagtgcagcagcagcagcagcgacccctacagcgtgagcgactgcggctaccccgtgaccaccttcgaggtgcccgtgagcgtgcacaccagaccccccatgaaggaggtggtgagaagctgcacccccatgaaggagagcaccaccatggagatctggatccacccccagccccagagaaagagcgagggcaaggtggccggcaagaccgtgctgaccagcagcagccccagcgccatgaccctgagctacctggactag

SEQ ID NO: 95666 - DNA, 1344 bp, Artificial Sequence
  Description of Artificial Sequence: Synthetic coding sequence
atggccaccgccgccaccaccaccaccaccaccaccgccaccgtggccctgaccaccagctgggacaacgccaccggcagacccaccgccgagcccgaccccatcctggacaactacgtgctgctggtggtggtgatgagcctgttcgtgggcggcaccctggtggtgctgagcggcgtgctgctgctgtgcaagagatgctgggacgtgcaccagagactgaacagagccatggaggaggccgagaagaccaccaccacctacctggacaacggcacccaccccgcccaggaccccgacttcagaggcgaggaccccgagtgccaggacgccgagaccgagagattcctgagcaccagcagcaccggcagaagagtgagcttcaacgaggccgccctgttcgagcagagcagaaagacccaggacaagggcagaagatacaccctgaccgagggcgacttccaccacctgaagaacgccagactgacccacctgcacctgccccccctgaagatcgtgaccatccacgagtgcgacagcggcgaggccagcagcgccaccaccccccaccccgccaccagccccaaggccaccctggccatcttccagccccccggcaaggccctgaccggcagaagcgtgggccccagcagcgccctgcccggcgacccctacaacagcgccgccggcgccaccgacttcgccgagatcagccccagcgccagcagcgacagcggcgagggcaccagcctggacgccggcaccagaagcaccaaggccggcggccccggcgccgccgccggccccggcgaggccggccccggcagcggcgccggcaccgtgctgcagttcctgaccagactgagaagacacgccagcctggacggcgccagcccctacttcaaggtgaagaagtggaagctggagcccagccagagagccgccagcctggacaccagaggcagccccaagagacaccacttccagagacagagagccgccagcgagagcaccgagcaggaggagggcgacgccccccaggaggacttcatccagtacatcgccagagccggcgacgccgtggccttcccccaccccagacccttcctggccagccccccccccgccctgggcagatacttcagcgtggacggcggcgccagaggcggccccgtgggcccctgcccccccagccccccccccagaagacccagagagagaagccccggccccgtggacaccagaagccccgccagcagcggcaaggccccccccagaggcggcctgaccggcgccaccagccccgcctggaccagaggcggcaagcagggcgagaccggctag

SEQ ID NO: 95667 - DNA, 3114 bp, Artificial Sequence
  Description of Artificial Sequence: Synthetic coding sequence
atgaccgtgggcttcaacagcgacatcagcagcgtggtgagagtgaacaccaccaactgccacaagtgcctgctgagcggcacctacatcttcgccgtgctgctggtgtgcgtggtgttccacagcggcgcccaggagaagaactacaccatcagagaggagatccccgagaacgtgctgatcggcaacctgctgaaggacctgaacctgagcctgatccccaacaagagcctgaccaccaccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaacgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgatgaaggtgagcgccaccgacgccgacagcggccccaacgccgagatcaactacctgctgggccccgacgccccccccgagttcagcctggacagaagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaagttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgcccccctacaactacagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcatcgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacatgcagaacagcgagtgggccacccccaaccccgagaacagacagatgatcatgatgaagaagaagaagaagaagaagaagcacagccccaagaacctgctgctgaacgtggtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacctgaagcaccacatcatccaggagctgcccctggacaacaccttcgtggcctgcgacagcatcagcaactgcagcagcagcagcagcgacccctacagcgtgagcgactgcggctaccccgtgaccaccttcgaggtgcccgtgagcgtgcacaccagacccaccgacagcagaacctag

SEQ ID NO: 95668 - DNA, 3147 bp, Artificial Sequence
  Description of Artificial Sequence: Synthetic coding sequence
atgttcagagtgggcttcctgatcatcagcagcagcagcagcctgagccccctgctgctggtgagcgtggtgagagtgaacaccaccaactgccacaagtgcctgctgagcggcacctacatcttcgccgtgctgctggtgtgcgtggtgttccacagcggcgcccaggagaagaactacaccatcagagaggagatccccgagaacgtgctgatcggcaacctgctgaaggacctgaacctgagcctgatccccaacaagagcctgaccaccaccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaacgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgatgaaggtgagcgccaccgacgccgacagcggccccaacgccgagatcaactacctgctgggccccgacgccccccccgagttcagcctggacagaagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaagttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgcccccctacaactacagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcatcgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacatgcagaacagcgagtgggccacccccaaccccgagaacagacagatgatcatgatgaagaagaagaagaagaagaagaagcacagccccaagaacctgctgctgaacgtggtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacctgaagcaccacatcatccaggagctgcccctggacaacaccttcgtggcctgcgacagcatcagcaactgcagcagcagcagcagcgacccctacagcgtgagcgactgcggctaccccgtgaccaccttcgaggtgcccgtgagcgtgcacaccagacccaccgacagcagaacctag

SEQ ID NO: 95669 - DNA, 3960 bp, Artificial Sequence
  Description of Artificial Sequence: Synthetic coding sequence
tgagtggtgagagtgaacaccaccaactgccacaagtgcctgctgagcggcacctacatcttcgccgtgctgctggtgtgcgtggtgttccacagcggcgcccaggagaagaactacaccatcagagaggagatccccgagaacgtgctgatcggcaacctgctgaaggacctgaacctgagcctgatccccaacaagagcctgaccaccaccatgcagttcaagctggtgtacaagaccggcgacgtgcccctgatcagaatcgaggaggacaccggcgagatcttcaccaccggcgccagaatcgacagagagaagctgtgcgccggcatccccagagacgagcactgcttctacgaggtggaggtggccatcctgcccgacgagatcttcagactggtgaagatcagattcctgatcgaggacatcaacgacaacgcccccctgttccccgccaccgtgatcaacatcagcatccccgagaacagcgccatcaacagcaagtacaccctgcccgccgccgtggaccccgacgtgggcatcaacggcgtgcagaactacgagctgatcaagagccagaacatcttcggcctggacgtgatcgagacccccgagggcgacaagatgccccagctgatcgtgcagaaggagctggacagagaggagaaggacacctacgtgatgaaggtgaaggtggaggacggcggcttcccccagagaagcagcaccgccatcctgcaggtgagcgtgaccgacaccaacgacaaccaccccgtgttcaaggagaccgagatcgaggtgagcatccccgagaacgcccccgtgggcaccagcgtgacccagctgcacgccaccgacgccgacatcggcgagaacgccaagatccacttcagcttcagcaacctggtgagcaacatcgccagaagactgttccacctgaacgccaccaccggcctgatcaccatcaaggagcccctggacagagaggagacccccaaccacaagctgctggtgctggccagcgacggcggcctgatgcccgccagagccatggtgctggtgaacgtgaccgacgtgaacgacaacgtgcccagcatcgacatcagatacatcgtgaaccccgtgaacgacaccgtggtgctgagcgagaacatccccctgaacaccaagatcgccctgatcaccgtgaccgacaaggacgccgaccacaacggcagagtgacctgcttcaccgaccacgagatccccttcagactgagacccgtgttcagcaaccagttcctgctggagaacgccgcctacctggactacgagagcaccaaggagtacgccatcaagctgctggccgccgacgccggcaagccccccctgaaccagagcgccatgctgttcatcaaggtgaaggacgagaacgacaacgcccccgtgttcacccagagcttcgtgaccgtgagcatccccgagaacaacagccccggcatccagctgatgaaggtgagcgccaccgacgccgacagcggccccaacgccgagatcaactacctgctgggccccgacgccccccccgagttcagcctggacagaagaaccggcatgctgaccgtggtgaagaagctggacagagagaaggaggacaagtacctgttcaccatcctggccaaggacaacggcgtgccccccctgaccagcaacgtgaccgtgttcgtgagcatcatcgaccagaacgacaacagccccgtgttcacccacaacgagtacaagttctacgtgcccgagaacctgcccagacacggcaccgtgggcctgatcaccgtgaccgaccccgactacggcgacaacagcgccgtgaccctgagcatcctggacgagaacgacgacttcaccatcgacagccagaccggcgtgatcagacccaacatcagcttcgacagagagaagcaggagagctacaccttctacgtgaaggccgaggacggcggcagagtgagcagaagcagcagcgccaaggtgaccatcaacgtggtggacgtgaacgacaacaagcccgtgttcatcgtgcccccctacaactacagctacgagctggtgctgcccagcaccaaccccggcaccgtggtgttccaggtgatcgccgtggacaacgacaccggcatgaacgccgaggtgagatacagcatcgtgggcggcaacaccagagacctgttcgccatcgaccaggagaccggcaacatcaccctgatggagaagtgcgacgtgaccgacctgggcctgcacagagtgctggtgaaggccaacgacctgggccagcccgacagcctgttcagcgtggtgatcgtgaacctgttcgtgaacgagagcgtgaccaacgccaccctgatcaacgagctggtgagaaagagcatcgaggcccccgtgacccccaacaccgagatcgccgacgtgagcagccccaccagcgactacgtgaagatcctggtggccgccgtggccggcaccatcaccgtggtggtggtgatcttcatcaccgccgtggtgagatgcagacaggccccccacctgaaggccgcccagaagaacatgcagaacagcgagtgggccacccccaaccccgagaacagacagatgatcatgatgaagaagaagaagaagaagaagaagcacagccccaagaacctgctgctgaacgtggtgaccatcgaggagaccaaggccgacgacgtggacagcgacggcaacagagtgaccctggacctgcccatcgacctggaggagcagaccatgggcaagtacaactgggtgaccacccccaccaccttcaagcccgacagccccgacctggccagacactacaagagcgccagcccccagcccgccttccagatccagcccgagacccccctgaacctgaagcaccacatcatccaggagctgcccctggacaacaccttcgtggcctgcgacagcatcagcaactgcagcagcagcagcagcgacccctacagcgtgagcgactgcggctaccccgtgaccaccttcgaggtgcccgtgagcgtgcacaccagacccagccagagaagagtgaccttccacctgcccgagggcagccaggagagcagcagcgacggcggcctgggcgaccacgacgccggcagcctgaccagcaccagccacggcctgcccctgggctacccccaggaggagtacttcgacagagccacccccagcaacagaaccgagggcgacggcaacagcgaccccgagagcaccttcatccccggcctgaagaaggagatcaccgtgcagcccaccgtggaggaggccagcgacaactgcacccaggagtgcctgatctacggccacagcgacgcctgctggatgcccgccagcctggaccacagcagcagcagccaggcccaggccagcgccctgtgccacagcccccccctgagccaggccagcacccagcaccacagcccccccgtgacccagaccatcgtgctgtgccacagcccccccgtgacccagaccatcgccctgtgccacagccccccccccatccaggtgagcgccctgcaccacagcccccccctggtgcagggcaccgccctgcaccacagcccccccagcgcccaggccagcgccctgtgctacagcccccccctggcccaggccgccgccatcagccacagcagcagcctgccccaggtgatcgccctgcacagaagccaggcccagagcagcgtgagcctgcagcagggctgggtgcagggcgccaacggcctgtgcagcgtggaccagggcgtgcagggcagcgccaccagccagttctacaccatgagcgagagactgcaccccagcgacgacagcatcaaggtgatccccctgaccaccttcgcccccagacagcaggccagacccagcagaggcgacagccccatcatggagacccaccccctgtag

SEQ ID NO: 95670 - DNA, 1080 bp, Artificial Sequence
  Description of Artificial Sequence: Synthetic coding sequence
atgagaagcatcagaaagagatggaccatctgcaccatcagcctgctgctgatcttctacaagaccaaggagatcgccagaaccgaggagcaccaggagacccagctgatcggcgacggcgagctgagcctgagcagaagcctggtgaacagcagcgacaagatcatcagaaaggccggcagcagcatcttccagcacaacgtggagggctggaagatcaacagcagcctggtgctggagatcagaaagaacatcctgagattcctggacgccgagagagacgtgagcgtggtgaagagcagcttcaagcccggcgacgtgatccactacgtgctggacagaagaagaaccctgaacatcagccacgacctgcacagcctgctgcccgaggtgagccccatgaagaacagaagattcaagacctgcgccgtggtgggcaacagcggcatcctgctggacagcgagtgcggcaaggagatcgacagccacaacttcgtgatcagatgcaacctggcccccgtggtggagttcgccgccgacgtgggcaccaagagcgacttcatcaccatgaaccccagcgtggtgcagagagccttcggcggcttcagaaacgagagcgacagagagaagttcgtgcacagactgagcatgctgaacgacagcgtgctgtggatccccgccttcatggtgaagggcggcgagaagcacgtggagtgggtgaacgccctgatcctgaagaacaagctgaaggtgagaaccgcctaccccagcctgagactgatccacgccgtgagaggctactggctgaccaacaaggtgcccatcaagagacccagcaccggcctgctgatgtacaccctggccaccagattctgcgacgagatccacctgtacggcttctggcccttccccaaggacctgaacggcaaggccgtgaagtaccactactacgacgacctgaagtacagatacttcagcaacgccagcccccacagaatgcccctggagttcaagaccctgaacgtgctgcacaacagaggcgccctgaagctgaccaccggcaagtgcgtgaagcagtag

SEQ ID NO: 95671 - DNA, 72 bp, Artificial Sequence
  Description of Artificial Sequence: Synthetic coding sequence
atgatgcagctgctgcagctgctgctgggcctgctgggccccggcggctacctgttcctgctgggcgactag

SEQ ID NO: 95672 - DNA, 3480 bp, Artificial Sequence
  Description of Artificial Sequence: Synthetic coding sequence
atgtacctgagcatctgctgctgcttcctgctgtgggcccccgccctgaccctgaagaacctgaactacagcgtgcccgaggagcagggcgccggcaccgtgatcggcaacatcggcagagacgccagactgcagcccggcctgccccccgccgagagaggcggcggcggcagaagcaagagcggcagctacagagtgctggagaacagcgccccccacctgctggacgtggacgccgacagcggcctgctgtacaccaagcagagaatcgacagagagagcctgtgcagacacaacgccaagtgccagctgagcctggaggtgttcgccaacgacaaggagatctgcatgatcaaggtggagatccaggacatcaacgacaacgcccccagcttcagcagcgaccagatcgagatggacatcagcgagaacgccgcccccggcaccagattccccctgaccagcgcccacgaccccgacgccggcgagaacggcctgagaacctacctgctgaccagagacgaccacggcctgttcggcctggacgtgaagagcagaggcgacggcaccaagttccccgagctggtgatccagaaggccctggacagagagcagcagaaccaccacaccctggtgctgaccgccctggacggcggcgagccccccagaagcgccaccgtgcagatcaacgtgaaggtgatcgacagcaacgacaacagccccgtgttcgaggcccccagctacctggtggagctgcccgagaacgcccccctgggcaccgtggtgatcgacctgaacgccaccgacgccgacgagggccccaacggcgaggtgctgtacagcttcagcagctacgtgcccgacagagtgagagagctgttcagcatcgaccccaagaccggcctgatcagagtgaagggcaacctggactacgaggagaacggcatgctggagatcgacgtgcaggccagagacctgggccccaaccccatccccgcccactgcaaggtgaccgtgaagctgatcgacagaaacgacaacgcccccagcatcggcttcgtgagcgtgagacagggcgccctgagcgaggccgccccccccggcaccgtgatcgccctggtgagagtgaccgacagagacagcggcaagaacggccagctgcagtgcagagtgctgggcggcggcggcaccggcggcggcggcggcctgggcggccccggcggcagcgtgcccttcaagctggaggagaactacgacaacttctacaccgtggtgaccgacagacccctggacagagagacccaggacgagtacaacgtgaccatcgtggccagagacggcggcagcccccccctgaacagcaccaagagcttcgccatcaagatcctggacgagaacgacaacccccccagattcaccaagggcctgtacgtgctgcaggtgcacgagaacaacatccccggcgagtacctgggcagcgtgctggcccaggaccccgacctgggccagaacggcaccgtgagctacagcatcctgcccagccacatcggcgacgtgagcatctacacctacgtgagcgtgaaccccaccaacggcgccatctacgccctgagaagcttcaacttcgagcagaccaaggccttcgagttcaaggtgctggccaaggacagcggcgcccccgcccacctggagagcaacgccaccgtgagagtgaccgtgctggacgtgaacgacaacgcccccgtgatcgtgctgcccaccctgcagaacgacaccgccgagctgcaggtgcccagaaacgccggcctgggctacctggtgagcaccgtgagagccctggacagcgacttcggcgagagcggcagactgacctacgagatcgtggacggcaacgacgaccacctgttcgagatcgaccccagcagcggcgagatcagaaccctgcaccccttctgggaggacgtgacccccgtggtggagctggtggtgaaggtgaccgaccacggcaagcccaccctgagcgccgtggccaagctgatcatcagaagcgtgagcggcagcctgcccgagggcgtgcccagagtgaacggcgagcagcaccactgggacatgagcctgcccctgatcgtgaccctgagcaccatcagcatcatcctgctggccgccatgatcaccatcgccgtgaagtgcaagagagagaacaaggagatcagaacctacaactgcagaatcgccgagtacagccacccccagctgggcggcggcaagggcaagaagaagaagatcaacaagaacgacatcatgctggtgcagagcgaggtggaggagagaaacgccatgaacgtgatgaacgtggtgagcagccccagcctggccaccagccccatgtacttcgactaccagaccagactgcccctgagcagccccagaagcgaggtgatgtacctgaagcccgccagcaacaacctgaccgtgccccagggccacgccggctgccacaccagcttcaccggccagggcaccaacgccagcgagacccccgccaccagaatgagcatcatccagaccgacaacttccccgccgagcccaactacatgggcagcagacagcagttcgtgcagagcagcagcaccttcaaggaccccgagagagccagcctgagagacagcggccacggcgacagcgaccaggccgacagcgaccaggacaccaacaagggcagctgctgcgacatgagcgtgagagaggccctgaagatgaagaccaccagcaccaagagccagcccctggagcaggagcccgaggagtgcgtgaactgcaccgacgagtgcagagtgctgggccacagcgacagatgctggatgccccagttccccgccgccaaccaggccgagaacgccgactacagaaccaacctgttcgtgcccaccgtggaggccaacgtggagaccgagacctacgagaccgtgaaccccaccggcaagaagaccttctgcaccttcggcaaggacaagagagagcacaccatcctgatcgccaacgtgaagccctacctgaaggccaagagagccctgagccccctgctgcaggaggtgcccagcgccagcagcagccccaccaaggcctgcatcgagccctgcaccagcaccaagggcagcctggacggctgcgaggccaagcccggcgccctggccgaggccagcagccagtacctgcccaccgacagccagtacctgagccccagcaagcagcccagagacccccccttcatggccagcgaccagatggccagagtgttcgccgacgtgcacagcagagccagcagagacagcagcgagatgggcgccgtgctggagcagctggaccaccccaacagagacctgggcagagagagcgtggacgccgaggaggtggtgagagagatcgacaagctgctgcaggactgcagaggcaacgaccccgtggccgtgagaaagtag

SEQ ID NO: 95673 - DNA, 3408 bp, Artificial Sequence
  Description of Artificial Sequence: Synthetic coding sequence
atgcaccagatgaacgccaagatgcacttcagattcgtgttcgccctgctgatcgtgagcttcaaccacgacgtgctgggcaagaacctgaagtacagaatctacgaggagcagagagtgggcagcgtgatcgccagactgagcgaggacgtggccgacgtgctgctgaagctgcccaaccccagcaccgtgagattcagagccatgcagagaggcaacagccccctgctggtggtgaacgaggacaacggcgagatcagcatcggcgccaccatcgacagagagcagctgtgccagaagaacctgaactgcagcatcgagttcgacgtgatcaccctgcccaccgagcacctgcagctgttccacatcgaggtggaggtgctggacatcaacgacaacagcccccagttcagcagaagcctgatccccatcgagatcagcgagagcgccgccgtgggcaccagaatccccctggacagcgccttcgaccccgacgtgggcgagaacagcctgcacacctacagcctgagcgccaacgacttcttcaacatcgaggtgagaaccagaaccgacggcgccaagtacgccgagctgatcgtggtgagagagctggacagagagctgaagagcagctacgagctgcagctgaccgccagcgacatgggcgtgccccagagaagcggcagcagcatcctgaagatcagcatcagcgacagcaacgacaacagccccgccttcgagcagcagagctacatcatccagctgctggagaacagccccgtgggcaccctgctgctggacctgaacgccaccgaccccgacgagggcgccaacggcaagatcgtgtacagcttcagcagccacgtgagccccaagatcatggagaccttcaagatcgacagcgagagaggccacctgaccctgttcaagcaggtggactacgagatcaccaagagctacgagatcgacgtgcaggcccaggacctgggccccaacagcatccccgcccactgcaagatcatcatcaaggtggtggacgtgaacgacaacaagcccgagatcaacatcaacctgatgagccccggcaaggaggagatcagctacatcttcgagggcgaccccatcgacaccttcgtggccctggtgagagtgcaggacaaggacagcggcctgaacggcgagatcgtgtgcaagctgcacggccacggccacttcaagctgcagaagacctacgagaacaactacctgatcctgaccaacgccaccctggacagagagaagagaagcgagtacagcctgaccgtgatcgccgaggacagaggcacccccagcctgagcaccgtgaagcacttcaccgtgcagatcaacgacatcaacgacaaccccccccacttccagagaagcagatacgagttcgtgatcagcgagaacaacagccccggcgcctacatcaccaccgtgaccgccaccgaccccgacctgggcgagaacggccaggtgacctacaccatcctggagagcttcatcctgggcagcagcatcaccacctacgtgaccatcgaccccagcaacggcgccatctacgccctgagaatcttcgaccacgaggaggtgagccagatcaccttcgtggtggaggccagagacggcggcagccccaagcagctggtgagcaacaccaccgtggtgctgaccatcatcgacgagaacgacaacgtgcccgtggtgatcggccccgccctgagaaacaacaccgccgagatcaccatccccaagggcgccgagagcggcttccacgtgaccagaatcagagccatcgacagagacagcggcgtgaacgccgagctgagctgcgccatcgtggccggcaacgaggagaacatcttcatcatcgaccccagaagctgcgacatccacaccaacgtgagcatggacagcgtgccctacaccgagtgggagctgagcgtgatcatccaggacaagggcaacccccagctgcacaccaaggtgctgctgaagtgcatgatcttcgagtacgccgagagcgtgaccagcaccgccatgaccagcgtgagccaggccagcctggacgtgagcatgatcatcatcatcagcctgggcgccatctgcgccgtgctgctggtgatcatggtgctgttcgccaccagatgcaacagagagaagaaggacaccagaagctacaactgcagagtggccgagagcacctaccagcaccaccccaagagacccagcagacagatccacaagggcgacatcaccctggtgcccaccatcaacggcaccctgcccatcagaagccaccacagaagcagccccagcagcagccccaccctggagagaggccagatgggcagcagacagagccacaacagccaccagagcctgaacagcctggtgaccatcagcagcaaccacgtgcccgagaacttcagcctggagctgacccacgccacccccgccgtggagcaggtgagccagctgctgagcatgctgcaccagggccagtaccagcccagacccagcttcagaggcaacaagtacagcagaagctacagatacgccctgcaggacatggacaagttcagcctgaaggacagcggcagaggcgacagcgaggccggcgacagcgactacgacctgggcagagacagccccatcgacagactgctgggcgagggcttcagcgacctgttcctgaccgacggcagaatccccgccgccatgagactgtgcaccgaggagtgcagagtgctgggccacagcgaccagtgctggatgccccccctgcccagccccagcagcgactacagaagcaacatgttcatccccggcgaggagttccccacccagccccagcagcagcacccccaccagagcctggaggacgacgcccagcccgccgacagcggcgagaagaagaagagcttcagcaccttcggcaaggacagccccaacgacgaggacaccggcgacaccagcaccagcagcctgctgagcgagatgagcagcgtgttccagagactgctgccccccagcctggacacctacagcgagtgcagcgaggtggacagaagcaacagcctggagagaagaaagggccccctgcccgccaagaccgtgggctacccccagggcgtggccgcctgggccgccagcacccacttccagaaccccaccaccaactgcggcccccccctgggcacccacagcagcgtgcagcccagcagcaagtggctgcccgccatggaggagatccccgagaactacgaggaggacgacttcgacaacgtgctgaaccacctgaacgacggcaagcacgagctgatggacgccagcgagctggtggccgagatcaacaagctgctgcaggacgtgagacagagctag

SEQ ID NO: 95674 - DNA, 3405 bp, Artificial Sequence
  Description of Artificial Sequence: Synthetic coding sequence
atgcaccagatgaacgccaagatgcacttcagattcgtgttcgccctgctgatcgtgagcttcaaccacgacgtgctgggcaagaacctgaagtacagaatctacgaggagcagagagtgggcagcgtgatcgccagactgagcgaggacgtggccgacgtgctgctgaagctgcccaaccccagcaccgtgagattcagagccatgcagagaggcaacagccccctgctggtggtgaacgaggacaacggcgagatcagcatcggcgccaccatcgacagagagcagctgtgccagaagaacctgaactgcagcatcgagttcgacgtgatcaccctgcccaccgagcacctgcagctgttccacatcgaggtggaggtgctggacatcaacgacaacagcccccagttcagcagaagcctgatccccatcgagatcagcgagagcgccgccgtgggcaccagaatccccctggacagcgccttcgaccccgacgtgggcgagaacagcctgcacacctacagcctgagcgccaacgacttcttcaacatcgaggtgagaaccagaaccgacggcgccaagtacgccgagctgatcgtggtgagagagctggacagagagctgaagagcagctacgagctgcagctgaccgccagcgacatgggcgtgccccagagaagcggcagcagcatcctgaagatcagcatcagcgacagcaacgacaacagccccgccttcgagcagcagagctacatcatccagctgctggagaacagccccgtgggcaccctgctgctggacctgaacgccaccgaccccgacgagggcgccaacggcaagatcgtgtacagcttcagcagccacgtgagccccaagatcatggagaccttcaagatcgacagcgagagaggccacctgaccctgttcaagcaggtggactacgagatcaccaagagctacgagatcgacgtgcaggcccaggacctgggccccaacagcatccccgcccactgcaagatcatcatcaaggtggtggacgtgaacgacaacaagcccgagatcaacatcaacctgatgagccccggcaaggaggagatcagctacatcttcgagggcgaccccatcgacaccttcgtggccctggtgagagtgcaggacaaggacagcggcctgaacggcgagatcgtgtgcaagctgcacggccacggccacttcaagctgcagaagacctacgagaacaactacctgatcctgaccaacgccaccctggacagagagaagagaagcgagtacagcctgaccgtgatcgccgaggacagaggcacccccagcctgagcaccgtgaagcacttcaccgtgcagatcaacgacatcaacgacaaccccccccacttccagagaagcagatacgagttcgtgatcagcgagaacaacagccccggcgcctacatcaccaccgtgaccgccaccgaccccgacctgggcgagaacggccaggtgacctacaccatcctggagagcttcatcctgggcagcagcatcaccacctacgtgaccatcgaccccagcaacggcgccatctacgccctgagaatcttcgaccacgaggaggtgagccagatcaccttcgtggtggaggccagagacggcggcagccccaagcagctggtgagcaacaccaccgtggtgctgaccatcatcgacgagaacgacaacgtgcccgtggtgatcggccccgccctgagaaacaacaccgccgagatcaccatccccaagggcgccgagagcggcttccacgtgaccagaatcagagccatcgacagagacagcggcgtgaacgccgagctgagctgcgccatcgtggccggcaacgaggagaacatcttcatcatcgaccccagaagctgcgacatccacaccaacgtgagcatggacagcgtgccctacaccgagtgggagctgagcgtgatcatccaggacaagggcaacccccagctgcacaccaaggtgctgctgaagtgcatgatcttcgagtacgccgagagcgtgaccagcaccgccatgaccagcgtgagccaggccagcctggacgtgagcatgatcatcatcatcagcctgggcgccatctgcgccgtgctgctggtgatcatggtgctgttcgccaccagatgcaacagagagaagaaggacaccagaagctacaactgcagagtggccgagagcacctaccagcaccaccccaagagacccagcagacagatccacaagggcgacatcaccctggtgcccaccatcaacggcaccctgcccatcagaagccaccacagaagcagccccagcagcagccccaccctggagagaggccagatgggcagcagacagagccacaacagccaccagagcctgaacagcctggtgaccatcagcagcaaccacgtgcccgagaacttcagcctggagctgacccacgccacccccgccgtggaggtgagccagctgctgagcatgctgcaccagggccagtaccagcccagacccagcttcagaggcaacaagtacagcagaagctacagatacgccctgcaggacatggacaagttcagcctgaaggacagcggcagaggcgacagcgaggccggcgacagcgactacgacctgggcagagacagccccatcgacagactgctgggcgagggcttcagcgacctgttcctgaccgacggcagaatccccgccgccatgagactgtgcaccgaggagtgcagagtgctgggccacagcgaccagtgctggatgccccccctgcccagccccagcagcgactacagaagcaacatgttcatccccggcgaggagttccccacccagccccagcagcagcacccccaccagagcctggaggacgacgcccagcccgccgacagcggcgagaagaagaagagcttcagcaccttcggcaaggacagccccaacgacgaggacaccggcgacaccagcaccagcagcctgctgagcgagatgagcagcgtgttccagagactgctgccccccagcctggacacctacagcgagtgcagcgaggtggacagaagcaacagcctggagagaagaaagggccccctgcccgccaagaccgtgggctacccccagggcgtggccgcctgggccgccagcacccacttccagaaccccaccaccaactgcggcccccccctgggcacccacagcagcgtgcagcccagcagcaagtggctgcccgccatggaggagatccccgagaactacgaggaggacgacttcgacaacgtgctgaaccacctgaacgacggcaagcacgagctgatggacgccagcgagctggtggccgagatcaacaagctgctgcaggacgtgagacagagctag

SEQ ID NO: 95675 - DNA, 3306 bp, Artificial Sequence
  Description of Artificial Sequence: Synthetic coding sequence
atggagagcctgctgctgcccgtgctgctgctgctggccatcctgtggacccaggccgccgccctgatcaacctgaagtacagcgtggaggaggagcagagagccggcaccgtgatcgccaacgtggccaaggacgccagagaggccggcttcgccctggaccccagacaggccagcgccttcagagtggtgagcaacagcgccccccacctggtggacatcaaccccagcagcggcctgctggtgaccaagcagaagatcgacagagacctgctgtgcagacagagccccaagtgcatcatcagcctggaggtgatgagcagcagcatggagatctgcgtgatcaaggtggagatcaaggacctgaacgacaacgcccccagcttccccgccgcccagatcgagctggagatcagcgaggccgccagccccggcaccagaatccccctggacagcgcctacgaccccgacagcggcagcttcggcgtgcagacctacgagctgacccccaacgagctgttcggcctggagatcaagaccagaggcgacggcagcagattcgccgagctggtggtggagaagagcctggacagagagacccagagccactacagcttcagaatcaccgccctggacggcggcgacccccccagactgggcaccgtgggcctgagcatcaaggtgaccgacagcaacgacaacaaccccgtgttcagcgagagcacctacgccgtgagcgtgcccgagaacagcccccccaacacccccgtgatcagactgaacgccagcgaccccgacgagggcaccaacggccaggtggtgtacagcttctacggctacgtgaacgacagaaccagagagctgttccagatcgacccccacagcggcctggtgaccgtgaccggcgccctggactacgaggagggccacgtgtacgagctggacgtgcaggccaaggacctgggccccaacagcatccccgcccactgcaaggtgaccgtgagcgtgctggacaccaacgacaacccccccgtgatcaacctgctgagcgtgaacagcgagctggtggaggtgagcgagagcgccccccccggctacgtgatcgccctggtgagagtgagcgacagagacagcggcctgaacggcagagtgcagtgcagactgctgggcaacgtgcccttcagactgcaggagtacgagagcttcagcaccatcctggtggacggcagactggacagagagcagcacgaccagtacaacctgaccatccaggccagagacggcggcgtgcccatgctgcagagcgccaagagcttcaccgtgctgatcaccgacgagaacgacaaccacccccacttcagcaagccctactaccaggtgatcgtgcaggagaacaacacccccggcgcctacctgctgagcgtgagcgccagagaccccgacctgggcctgaacggcagcgtgagctaccagatcgtgcccagccaggtgagagacatgcccgtgttcacctacgtgagcatcaaccccaacagcggcgacatctacgccctgagaagcttcaaccacgagcagaccaaggccttcgagttcaaggtgctggccaaggacggcggcctgcccagcctgcagagcaacgccaccgtgagagtgatcatcctggacgtgaacgacaacacccccgtgatcaccgccccccccctgatcaacggcaccgccgaggtgtacatccccagaaacagcggcatcggctacctggtgaccgtggtgaaggccgaggactacgacgagggcgagaacggcagagtgacctacgacatgaccgagggcgacagaggcttcttcgagatcgaccaggtgaacggcgaggtgagaaccaccagaaccttcggcgagagcagcaagagcagctacgagctgatcgtggtggcccacgaccacggcaagaccagcctgagcgccagcgccctggtgctgatctacctgagccccgccctggacgcccaggagagcatgggcagcgtgaacctgagcctgatcttcatcatcgccctgggcagcatcgccggcatcctgttcgtgaccatgatcttcgtggccatcaagtgcaagagagacaacaaggagatcagaacctacaactgcagaatcgccgagtacagctacggccaccagaagaagagcagcaagaagaagaagatcagcaagaacgacatcagactggtgcccagagacgtggaggagaccgacaagatgaacgtggtgagctgcagcagcctgaccagcagcctgaactacttcgactaccaccagcagaccctgcccctgggctgcagaagaagcgagagcaccttcctgaacgtggagaaccagaacaccagaaacaccagcgccaaccacatctaccaccacagcttcaacagccagggcccccagcagcccgacctgatcatcaacggcgtgcccctgcccgagaccgagaactacagcttcgacagcaactacgtgaacagcagagcccacctgatcaagagcagcagcaccttcaaggacctggagggcaacagcctgaaggacagcggccacgaggagagcgaccagaccgacagcgagcacgacgtgcagagaagcctgtactgcgacaccgccgtgaacgacgtgctgaacaccagcgtgaccagcatgggcagccagatgcccgaccacgaccagaacgagggcttccactgcagagaggagtgcagaatcctgggccacagcgacagatgctggatgcccagaaaccccatgcccatcagaagcaagagccccgagcacgtgagaaacatcatcgccctgagcatcgaggccaccgccgccgacgtggaggcctacgacgactgcggccccaccaagagaaccttcgccaccttcggcaaggacgtgagcgaccaccccgccgaggagagacccaccctgaagggcaagagaaccgtggacgtgaccatctgcagccccaaggtgaacagcgtgatcagagaggccggcaacggctgcgaggccatcagccccgtgaccagccccctgcacctgaagagcagcctgcccaccaagcccagcgtgagctacaccatcgccctggccccccccgccagagacctggagcagtacgtgaacaacgtgaacaacggccccaccagacccagcgaggccgagcccagaggcgccgacagcgagaaggtgatgcacgaggtgagccccatcctgaaggagggcagaaacaaggagagccccggcgtgaagagactgaaggacatcgtgctgtag

SEQ ID NO: 95676 - DNA, 3447 bp, Artificial Sequence
  Description of Artificial Sequence: Synthetic coding sequence
atggagagcctgctgctgcccgtgctgctgctgctggccatcctgtggacccaggccgccgccctgatcaacctgaagtacagcgtggaggaggagcagagagccggcaccgtgatcgccaacgtggccaaggacgccagagaggccggcttcgccctggaccccagacaggccagcgccttcagagtggtgagcaacagcgccccccacctggtggacatcaaccccagcagcggcctgctggtgaccaagcagaagatcgacagagacctgctgtgcagacagagccccaagtgcatcatcagcctggaggtgatgagcagcagcatggagatctgcgtgatcaaggtggagatcaaggacctgaacgacaacgcccccagcttccccgccgcccagatcgagctggagatcagcgaggccgccagccccggcaccagaatccccctggacagcgcctacgaccccgacagcggcagcttcggcgtgcagacctacgagctgacccccaacgagctgttcggcctggagatcaagaccagaggcgacggcagcagattcgccgagctggtggtggagaagagcctggacagagagacccagagccactacagcttcagaatcaccgccctggacggcggcgacccccccagactgggcaccgtgggcctgagcatcaaggtgaccgacagcaacgacaacaaccccgtgttcagcgagagcacctacgccgtgagcgtgcccgagaacagcccccccaacacccccgtgatcagactgaacgccagcgaccccgacgagggcaccaacggccaggtggtgtacagcttctacggctacgtgaacgacagaaccagagagctgttccagatcgacccccacagcggcctggtgaccgtgaccggcgccctggactacgaggagggccacgtgtacgagctggacgtgcaggccaaggacctgggccccaacagcatccccgcccactgcaaggtgaccgtgagcgtgctggacaccaacgacaacccccccgtgatcaacctgctgagcgtgaacagcgagctggtggaggtgagcgagagcgccccccccggctacgtgatcgccctggtgagagtgagcgacagagacagcggcctgaacggcagagtgcagtgcagactgctgggcaacgtgcccttcagactgcaggagtacgagagcttcagcaccatcctggtggacggcagactggacagagagcagcacgaccagtacaacctgaccatccaggccagagacggcggcgtgcccatgctgcagagcgccaagagcttcaccgtgctgatcaccgacgagaacgacaaccacccccacttcagcaagccctactaccaggtgatcgtgcaggagaacaacacccccggcgcctacctgctgagcgtgagcgccagagaccccgacctgggcctgaacggcagcgtgagctaccagatcgtgcccagccaggtgagagacatgcccgtgttcacctacgtgagcatcaaccccaacagcggcgacatctacgccctgagaagcttcaaccacgagcagaccaaggccttcgagttcaaggtgctggccaaggacggcggcctgcccagcctgcagagcaacgccaccgtgagagtgatcatcctggacgtgaacgacaacacccccgtgatcaccgccccccccctgatcaacggcaccgccgaggtgtacatccccagaaacagcggcatcggctacctggtgaccgtggtgaaggccgaggactacgacgagggcgagaacggcagagtgacctacgacatgaccgagggcgacagaggcttcttcgagatcgaccaggtgaacggcgaggtgagaaccaccagaaccttcggcgagagcagcaagagcagctacgagctgatcgtggtggcccacgaccacggcaagaccagcctgagcgccagcgccctggtgctgatctacctgagccccgccctggacgcccaggagagcatgggcagcgtgaacctgagcctgatcttcatcatcgccctgggcagcatcgccggcatcctgttcgtgaccatgatcttcgtggccatcaagtgcaagagagacaacaaggagatcagaacctacaactgcagcaactgcctgaccatcacctgcctgctgggctgcttcatcaagggccagaacagcaagtgcctgcactgcatcagcgtgagccccatcagcgaggagcaggacaagaagaccgaggagaaggtgagcctgagaggcaagagaatcgccgagtacagctacggccaccagaagaagagcagcaagaagaagaagatcagcaagaacgacatcagactggtgcccagagacgtggaggagaccgacaagatgaacgtggtgagctgcagcagcctgaccagcagcctgaactacttcgactaccaccagcagaccctgcccctgggctgcagaagaagcgagagcaccttcctgaacgtggagaaccagaacaccagaaacaccagcgccaaccacatctaccaccacagcttcaacagccagggcccccagcagcccgacctgatcatcaacggcgtgcccctgcccgagaccgagaactacagcttcgacagcaactacgtgaacagcagagcccacctgatcaagagcagcagcaccttcaaggacctggagggcaacagcctgaaggacagcggccacgaggagagcgaccagaccgacagcgagcacgacgtgcagagaagcctgtactgcgacaccgccgtgaacgacgtgctgaacaccagcgtgaccagcatgggcagccagatgcccgaccacgaccagaacgagggcttccactgcagagaggagtgcagaatcctgggccacagcgacagatgctggatgcccagaaaccccatgcccatcagaagcaagagccccgagcacgtgagaaacatcatcgccctgagcatcgaggccaccgccgccgacgtggaggcctacgacgactgcggccccaccaagagaaccttcgccaccttcggcaaggacgtgagcgaccaccccgccgaggagagacccaccctgaagggcaagagaaccgtggacgtgaccatctgcagccccaaggtgaacagcgtgatcagagaggccggcaacggctgcgaggccatcagccccgtgaccagccccctgcacctgaagagcagcctgcccaccaagcccagcgtgagctacaccatcgccctggccccccccgccagagacctggagcagtacgtgaacaacgtgaacaacggccccaccagacccagcgaggccgagcccagaggcgccgacagcgagaaggtgatgcacgaggtgagccccatcctgaaggagggcagaaacaaggagagccccggcgtgaagagactgaaggacatcgtgctgtag

SEQ ID NO: 95677 - DNA, 3303 bp, Artificial Sequence
  Description of Artificial Sequence: Synthetic coding sequence
atggagagcctgctgctgcccgtgctgctgctgctggccatcctgtggacccaggccgccgccctgatcaacctgaagtacagcgtggaggaggagcagagagccggcaccgtgatcgccaacgtggccaaggacgccagagaggccggcttcgccctggaccccagacaggccagcgccttcagagtggtgagcaacagcgccccccacctggtggacatcaaccccagcagcggcctgctggtgaccaagcagaagatcgacagagacctgctgtgcagacagagccccaagtgcatcatcagcctggaggtgatgagcagcagcatggagatctgcgtgatcaaggtggagatcaaggacctgaacgacaacgcccccagcttccccgccgcccagatcgagctggagatcagcgaggccgccagccccggcaccagaatccccctggacagcgcctacgaccccgacagcggcagcttcggcgtgcagacctacgagctgacccccaacgagctgttcggcctggagatcaagaccagaggcgacggcagcagattcgccgagctggtggtggagaagagcctggacagagagacccagagccactacagcttcagaatcaccgccctggacggcggcgacccccccagactgggcaccgtgggcctgagcatcaaggtgaccgacagcaacgacaacaaccccgtgttcagcgagagcacctacgccgtgagcgtgcccgagaacagcccccccaacacccccgtgatcagactgaacgccagcgaccccgacgagggcaccaacggccaggtggtgtacagcttctacggctacgtgaacgacagaaccagagagctgttccagatcgacccccacagcggcctggtgaccgtgaccggcgccctggactacgaggagggccacgtgtacgagctggacgtgcaggccaaggacctgggccccaacagcatccccgcccactgcaaggtgaccgtgagcgtgctggacaccaacgacaacccccccgtgatcaacctgctgagcgtgaacagcgagctggtggaggtgagcgagagcgccccccccggctacgtgatcgccctggtgagagtgagcgacagagacagcggcctgaacggcagagtgcagtgcagactgctgggcaacgtgcccttcagactgcaggagtacgagagcttcagcaccatcctggtggacggcagactggacagagagcagcacgaccagtacaacctgaccatccaggccagagacggcggcgtgcccatgctgcagagcgccaagagcttcaccgtgctgatcaccgacgagaacgacaaccacccccacttcagcaagccctactaccaggtgatcgtgcaggagaacaacacccccggcgcctacctgctgagcgtgagcgccagagaccccgacctgggcctgaacggcagcgtgagctaccagatcgtgcccagccaggtgagagacatgcccgtgttcacctacgtgagcatcaaccccaacagcggcgacatctacgccctgagaagcttcaaccacgagcagaccaaggccttcgagttcaaggtgctggccaaggacggcggcctgcccagcctgcagagcaacgccaccgtgagagtgatcatcctggacgtgaacgacaacacccccgtgatcaccgccccccccctgatcaacggcaccgccgaggtgtacatccccagaaacagcggcatcggctacctggtgaccgtggtgaaggccgaggactacgacgagggcgagaacggcagagtgacctacgacatgaccgagggcgacagaggcttcttcgagatcgaccaggtgaacggcgaggtgagaaccaccagaaccttcggcgagagcagcaagagcagctacgagctgatcgtggtggcccacgaccacggcaagaccagcctgagcgccagcgccctggtgctgatctacctgagccccgccctggacgcccaggagagcatgggcagcgtgaacctgagcctgatcttcatcatcgccctgggcagcatcgccggcatcctgttcgtgaccatgatcttcgtggccatcaagtgcaagagagacaacaaggagatcagaacctacaactgcagaatcgccgagtacagctacggccaccagaagaagagcagcaagaagaagaagatcagcaagaacgacatcagactggtgcccagagacgtggaggagaccgacaagatgaacgtggtgagctgcagcagcctgaccagcagcctgaactacttcgactaccaccagcagaccctgcccctgggctgcagaagaagcgagagcaccttcctgaacgtggagaaccagaacaccagaaacaccagcgccaaccacatctaccaccacagcttcaacagccagggcccccagcagcccgacctgatcatcaacggcgtgcccctgcccgagaccgagaactacagcttcgacagcaactacgtgaacagcagagcccacctgatcaagagcagcaccttcaaggacctggagggcaacagcctgaaggacagcggccacgaggagagcgaccagaccgacagcgagcacgacgtgcagagaagcctgtactgcgacaccgccgtgaacgacgtgctgaacaccagcgtgaccagcatgggcagccagatgcccgaccacgaccagaacgagggcttccactgcagagaggagtgcagaatcctgggccacagcgacagatgctggatgcccagaaaccccatgcccatcagaagcaagagccccgagcacgtgagaaacatcatcgccctgagcatcgaggccaccgccgccgacgtggaggcctacgacgactgcggccccaccaagagaaccttcgccaccttcggcaaggacgtgagcgaccaccccgccgaggagagacccaccctgaagggcaagagaaccgtggacgtgaccatctgcagccccaaggtgaacagcgtgatcagagaggccggcaacggctgcgaggccatcagccccgtgaccagccccctgcacctgaagagcagcctgcccaccaagcccagcgtgagctacaccatcgccctggccccccccgccagagacctggagcagtacgtgaacaacgtgaacaacggccccaccagacccagcgaggccgagcccagaggcgccgacagcgagaaggtgatgcacgaggtgagccccatcctgaaggagggcagaaacaaggagagccccggcgtgaagagactgaaggacatcgtgctgtag

SEQ ID NO: 95678 - DNA, 2094 bp, Artificial Sequence
  Description of Artificial Sequence: Synthetic coding sequence
atgttcaccctggacgtggaggagaacgagaacggcgagagaaccccctacctgatcgtgatgggcgccctggacagagagacccaggaccagtacgtgagcatcatcatcgccgaggacggcggcagcccccccctgctgggcagcgccaccctgaccatcggcatcagcgacatcaacgacaactgccccctgttcaccgacagccagatcaacgtgaccgtgtacggcaacgccaccgtgggcacccccatcgccgccgtgcaggccgtggacaaggacctgggcaccaacgcccagatcacctacagctacagccagaaggtgccccaggccagcaaggacctgttccacctggacgagaacaccggcgtgatcaagctgttcagcaagatcggcggcagcgtgctggagagccacaagctgaccatcctggccaacggccccggctgcatccccgccgtgatcaccgccctggtgagcatcatcaaggtgatcttcagaccccccgagatcgtgcccagatacatcgccaacgagatcgacggcgtggtgtacctgaaggagctggagcccgtgaacacccccatcgccttcttcaccatcagagaccccgagggcaagtacaaggtgaactgctacctggacggcgagggccccttcagactgagcccctacaagccctacaacaacgagtacctgctggagaccaccaagcccatggactacgagctgcagcagttctacgaggtggccgtggtggcctggaacagcgagggcttccacgtgaagagagtgatcaaggtgcagctgctggacgacaacgacaacgcccccatcttcctgcagcccctgatcgagctgaccatcgaggagaacaacagccccaacgccttcctgaccaagctgtacgccaccgacgccgacagcgaggagagaggccaggtgagctacttcctgggccccgacgcccccagctacttcagcctggacagcgtgaccggcatcctgaccgtgagcacccagctggacagagaggagaaggagaagtacagatacaccgtgagagccgtggactgcggcaagccccccagagagagcgtggccaccgtggccctgaccgtgctggacaagaacgacaacagccccagattcatcaacaaggacttcagcttcttcgtgcccgagaacttccccggctacggcgagatcggcgtgatcagcgtgaccgacgccgacgccggcagaaacggctgggtggccctgagcgtggtgaaccagagcgacatcttcgtgatcgacaccggcaagggcatgctgagagccaaggtgagcctggacagagagcagcagagcagctacaccctgtgggtggaggccgtggacggcggcgagcccgccctgagcagcaccgccaagatcaccatcctgctgctggacatcaacgacaacccccccctggtgctgttcccccagagcaacatgagctacctgctggtgctgcccagcaccctgcccggcagccccgtgaccgaggtgtacgccgtggacaaggacaccggcatgaacgccgtgatcgcctacagcatcatcggcagaagaggccccagacccgagagcttcagaatcgaccccaagaccggcaacatcaccctggaggaggccctgctgcagaccgactacggcctgcacagactgctggtgaaggtgagcgaccacggctaccccgagcccctgcacagcaccgtgatggtgaacctgttcgtgaacgacaccgtgagcaacgagagctacatcgagagcctgctgagaaaggagcccgagatcaacatcgaggagaaggagccccagatcagcatcgagcccacccacagaaaggtggagagcgtgagctgcatgcccaccctggtggccctgagcgtgatcagcctgggcagcatcaccctggtgaccggcatgggcatctacatctgcctgagaaagggcgagaagcaccccagagaggacgagaacctggaggtgcagatccccctgaagggcaagatcgacctgcacatgagagagagaaagcccatggacatcagcaacatctag

SEQ ID NO: 95679 - DNA, 2856 bp, Artificial Sequence
  Description of Artificial Sequence: Synthetic coding sequence
atgagaggcagaggcaacgccagaagcagccaggccctgggcgtgagctggtgccccgccacctggcaccccagactggacatgggcagactgcacagacccagaagcagcaccagctacagaaacctgccccacctgttcctgttcttcctgttcgtgggccccttcagctgcctgggcagctacagcagagccaccgagctgctgtacagcctgaacgagggcctgcccgccggcgtgctgatcggcagcctggccgaggacctgagactgctgcccagaagcgccggcagacccgacccccagagccagctgcccgagagaaccggcgccgagtggaacccccccctgagcttcagcctggccagcagaggcctgagcggccagtacgtgaccctggacaacagaagcggcgagctgcacaccagcgcccaggagatcgacagagaggccctgtgcgtggagggcggcggcggcaccgcctggagcggcagcgtgagcatcagcagcagccccagcgacagctgcctgctgctgctggacgtgctggtgctgccccaggagtacttcagattcgtgaaggtgaagatcgccatcagagacatcaacgacaacgccccccagttccccgtgagccagatcagcgtgtgggtgcccgagaacgcccccgtgaacaccagactggccatcgagcaccccgccgtggaccccgacgtgggcatcaacggcgtgcagacctacagactgctggactaccacggcatgttcaccctggacgtggaggagaacgagaacggcgagagaaccccctacctgatcgtgatgggcgccctggacagagagacccaggaccagtacgtgagcatcatcatcgccgaggacggcggcagcccccccctgctgggcagcgccaccctgaccatcggcatcagcgacatcaacgacaactgccccctgttcaccgacagccagatcaacgtgaccgtgtacggcaacgccaccgtgggcacccccatcgccgccgtgcaggccgtggacaaggacctgggcaccaacgcccagatcacctacagctacagccagaaggtgccccaggccagcaaggacctgttccacctggacgagaacaccggcgtgatcaagctgttcagcaagatcggcggcagcgtgctggagagccacaagctgaccatcctggccaacggccccggctgcatccccgccgtgatcaccgccctggtgagcatcatcaaggtgatcttcagaccccccgagatcgtgcccagatacatcgccaacgagatcgacggcgtggtgtacctgaaggagctggagcccgtgaacacccccatcgccttcttcaccatcagagaccccgagggcaagtacaaggtgaactgctacctggacggcgagggccccttcagactgagcccctacaagccctacaacaacgagtacctgctggagaccaccaagcccatggactacgagctgcagcagttctacgaggtggccgtggtggcctggaacagcgagggcttccacgtgaagagagtgatcaaggtgcagctgctggacgacaacgacaacgcccccatcttcctgcagcccctgatcgagctgaccatcgaggagaacaacagccccaacgccttcctgaccaagctgtacgccaccgacgccgacagcgaggagagaggccaggtgagctacttcctgggccccgacgcccccagctacttcagcctggacagcgtgaccggcatcctgaccgtgagcacccagctggacagagaggagaaggagaagtacagatacaccgtgagagccgtggactgcggcaagccccccagagagagcgtggccaccgtggccctgaccgtgctggacaagaacgacaacagccccagattcatcaacaaggacttcagcttcttcgtgcccgagaacttccccggctacggcgagatcggcgtgatcagcgtgaccgacgccgacgccggcagaaacggctgggtggccctgagcgtggtgaaccagagcgacatcttcgtgatcgacaccggcaagggcatgctgagagccaaggtgagcctggacagagagcagcagagcagctacaccctgtgggtggaggccgtggacggcggcgagcccgccctgagcagcaccgccaagatcaccatcctgctgctggacatcaacgacaacccccccctggtgctgttcccccagagcaacatgagctacctgctggtgctgcccagcaccctgcccggcagccccgtgaccgaggtgtacgccgtggacaaggacaccggcatgaacgccgtgatcgcctacagcatcatcggcagaagaggccccagacccgagagcttcagaatcgaccccaagaccggcaacatcaccctggaggaggccctgctgcagaccgactacggcctgcacagactgctggtgaaggtgagcgaccacggctaccccgagcccctgcacagcaccgtgatggtgaacctgttcgtgaacgacaccgtgagcaacgagagctacatcgagagcctgctgagaaaggagcccgagatcaacatcgaggagaaggagccccagatcagcatcgagcccacccacagaaaggtggagagcgtgagctgcatgcccaccctggtggccctgagcgtgatcagcctgggcagcatcaccctggtgaccggcatgggcatctacatctgcctgagaaagggcgagaagcaccccagagaggacgagaacctggaggtgcagatccccctgaagggcaagatcgacctgcacatgagagagagaaagcccatggacatcagcaacatctag

SEQ ID NO: 95680 - DNA, 2856 bp, Artificial Sequence; identical to SEQ ID NO: 95679
  Description of Artificial Sequence: Synthetic coding sequence

SEQ ID NO: 95681 - DNA, 3603 bp, Artificial Sequence
  Description of Artificial Sequence: Synthetic coding sequence
atgctgagaatgagaaccgccggctgggccagaggctggtgcctgggctgctgcctgctgctgcccctgagcctgagcctggccgccgccaagcagctgctgagatacagactggccgaggagggccccgccgacgtgagaatcggcaacgtggccagcgacctgggcatcgtgaccggcagcggcgaggtgaccttcagcctggagagcggcagcgagtacctgaagatcgacaacctgaccggcgagctgagcaccagcgagagaagaatcgacagagagaagctgccccagtgccagatgatcttcgacgagaacgagtgcttcctggacttcgaggtgagcgtgatcggccccagccagagctgggtggacctgttcgagggccaggtgatcgtgctggacatcaacgacaacacccccaccttccccagccccgtgctgaccctgaccgtggaggagaacagacccgtgggcaccctgtacctgctgcccaccgccaccgacagagacttcggcagaaacggcatcgagagatacgagctgctgcaggagcccggcggcggcggcagcggcggcgagagcagaagagccggcgccgccgacagcgccccctaccccggcggcggcggcaacggcgccagcggcggcggcagcggcggcagcaagagaagactggacgccagcgagggcggcggcggcaccaaccccggcggcagaagcagcgtgttcgagctgcaggtggccgacacccccgacggcgagaagcagccccagctgatcgtgaagggcgtgtacgaggccgacctggccgagaacagcgcccccggcacccccatcctgcagctgagagccgccgacctggacgtgggcgtgaacggccagatcgagtacgtgttcggcgccgccaccgagagcgtgagaagactgctgagactggacgagaccagcggctggctgagcgtgctgcacagaatcgacagagaggaggtgaaccagctgagattcaccgtgatggccagagacagaggccagccccccaagaccgacaaggccaccgtggtgctgaacatcaaggacgagaacgacaacgtgcccagcatcgagatcagaaagatcggcagaatccccctgaaggacggcgtggccaacgtggccgaggacgtgctggtggacacccccatcgccctggtgcaggtgagcgacagagaccagggcgagaacggcgtggtgacctgcaccgtggtgggcgacgtgcccttccagctgaagcccgccagcgacaccgagggcgaccagaacaagaagaagtacttcctgcacaccagcacccccctggactacgaggccaccagagagttcaacgtggtgatcgtggccgtggacagcggcagccccagcctgagcagcaacaacagcctgatcgtgaaggtgggcgacaccaacgacaacccccccatgttcggccagagcgtggtggaggtgtacttccccgagaacaacatccccggcgagagagtggccaccgtgctggccaccgacgccgacagcggcaagaacgccgagatcgcctacagcctggacagcagcgtgatgggcatcttcgccatcgaccccgacagcggcgacatcctggtgaacaccgtgctggacagagagcagaccgacagatacgagttcaaggtgaacgccaaggacaagggcatccccgtgctgcagggcagcaccaccgtgatcgtgcaggtggccgacaagaacgacaacgaccccaagttcatgcaggacgtgttcaccttctacgtgaaggagaacctgcagcccaacagccccgtgggcatggtgaccgtgatggacgccgacaagggcagaaacgccgagatgagcctgtacatcgaggagaacaacaacatcttcagcatcgagaacgacaccggcaccatctacagcaccatgagcttcgacagagagcaccagaccacctacaccttcagagtgaaggccgtggacggcggcgacccccccagaagcgccaccgccaccgtgagcctgttcgtgatggacgagaacgacaacgcccccaccgtgaccctgcccaagaacatcagctacaccctgctgccccccagcagcaacgtgagaaccgtggtggccaccgtgctggccaccgacagcgacgacggcatcaacgccgacctgaactacagcatcgtgggcggcaaccccttcaagctgttcgagatcgaccccaccagcggcgtggtgagcctggtgggcaagctgacccagaagcactacggcctgcacagactggtggtgcaggtgaacgacagcggccagcccagccagagcaccaccaccctggtgcacgtgttcgtgaacgagagcgtgagcaacgccaccgccatcgacagccagatcgccagaagcctgcacatccccctgacccaggacatcgccggcgaccccagctacgagatcagcaagcagagactgagcatcgtgatcggcgtggtggccggcatcatgaccgtgatcctgatcatcctgatcgtggtgatggccagatactgcagaagcaagaacaagaacggctacgaggccggcaagaaggaccacgaggacttcttcaccccccagcagcacgacaagagcaagaagcccaagaaggacaagaagaacaagaagagcaagcagcccctgtacagcagcatcgtgaccgtggaggccagcaagcccaacggccagagatacgacagcgtgaacgagaagctgagcgacagccccagcatgggcagatacagaagcgtgaacggcggccccggcagccccgacctggccagacactacaagagcagcagccccctgcccaccgtgcagctgcacccccagagccccaccgccggcaagaagcaccaggccgtgcaggacctgccccccgccaacaccttcgtgggcgccggcgacaacatcagcatcggcagcgaccactgcagcgagtacagctgccagaccaacaacaagtacagcaagcagcccttcagaagagtgaccttcagcgtggtgagccagccccaggacccccaccagggcagcctgcagagctgctacgacagcggcctggaggagagcgagacccccagcagcaagagcagcagcggccccagactgggcgccctgcccctgcccgaggacaactacgagagaaccacccccgacggcagcgtggacagcagacccctgcccgacgtggccctgaccggcaagtgcaccagagagtgcgacgagtacggccacagcgacagctgctggatgcccgtgagaaccagccccgagagaaagaagagccagcccaagctgagcaccttcatgcccgtggacgagagaggcagccaggagaagctggccaacggcgaggccgccatcatgggcgacagaaacagaaacctgctgaacaagaagctgaccagcagctacgagaccttcagcgccgccagcttcagcaagaacgaggaggccaaccccgaggacatccccctgaccaagaccggcgagtacaagcccagccccgtgaacaccctgaccagaagagaggtgtacctgtag

SEQ ID NO: 95682 - DNA, 3210 bp, Artificial Sequence
  Description of Artificial Sequence: Synthetic coding sequence
atgctgagaatgagaaccgccggctgggccagaggctggtgcctgggctgctgcctgctgctgcccctgagcctgagcctggccgccgccaagcagctgctgagatacagactggccgaggagggccccgccgacgtgagaatcggcaacgtggccagcgacctgggcatcgtgaccggcagcggcgaggtgaccttcagcctggagagcggcagcgagtacctgaagatcgacaacctgaccggcgagctgagcaccagcgagagaagaatcgacagagagaagctgccccagtgccagatgatcttcgacgagaacgagtgcttcctggacttcgaggtgagcgtgatcggccccagccagagctgggtggacctgttcgagggccaggtgatcgtgctggacatcaacgacaacacccccaccttccccagccccgtgctgaccctgaccgtggaggagaacagacccgtgggcaccctgtacctgctgcccaccgccaccgacagagacttcggcagaaacggcatcgagagatacgagctgctgcaggagcccggcggcggcggcagcggcggcgagagcagaagagccggcgccgccgacagcgccccctaccccggcggcggcggcaacggcgccagcggcggcggcagcggcggcagcaagagaagactggacgccagcgagggcggcggcggcaccaaccccggcggcagaagcagcgtgttcgagctgcaggtggccgacacccccgacggcgagaagcagccccagctgatcgtgaagggcgccctggacagagagcagagagacagctacgagctgaccctgagagtgagagacggcggcgacccccccagaagcagccaggccatcctgagagtgctgatcaccgacgtgaacgacaacagccccagattcgagaagagcgtgtacgaggccgacctggccgagaacagcgcccccggcacccccatcctgcagctgagagccgccgacctggacgtgggcgtgaacggccagatcgagtacgtgttcggcgccgccaccgagagcgtgagaagactgctgagactggacgagaccagcggctggctgagcgtgctgcacagaatcgacagagaggaggtgaaccagctgagattcaccgtgatggccagagacagaggccagccccccaagaccgacaaggccaccgtggtgctgaacatcaaggacgagaacgacaacgtgcccagcatcgagatcagaaagatcggcagaatccccctgaaggacggcgtggccaacgtggccgaggacgtgctggtggacacccccatcgccctggtgcaggtgagcgacagagaccagggcgagaacggcgtggtgacctgcaccgtggtgggcgacgtgcccttccagctgaagcccgccagcgacaccgagggcgaccagaacaagaagaagtacttcctgcacaccagcacccccctggactacgaggccaccagagagttcaacgtggtgatcgtggccgtggacagcggcagccccagcctgagcagcaacaacagcctgatcgtgaaggtgggcgacaccaacgacaacccccccatgttcggccagagcgtggtggaggtgtacttccccgagaacaacatccccggcgagagagtggccaccgtgctggccaccgacgccgacagcggcaagaacgccgagatcgcctacagcctggacagcagcgtgatgggcatcttcgccatcgaccccgacagcggcgacatcctggtgaacaccgtgctggacagagagcagaccgacagatacgagttcaaggtgaacgccaaggacaagggcatccccgtgctgcagggcagcaccaccgtgatcgtgcaggtggccgacaagaacgacaacgaccccaagttcatgcaggacgtgttcaccttctacgtgaaggagaacctgcagcccaacagccccgtgggcatggtgaccgtgatggacgccgacaagggcagaaacgccgagatgagcctgtacatcgaggagaacaacaacatcttcagcatcgagaacgacaccggcaccatctacagcaccatgagcttcgacagagagcaccagaccacctacaccttcagagtgaaggccgtggacggcggcgacccccccagaagcgccaccgccaccgtgagcctgttcgtgatggacgagaacgacaacgcccccaccgtgaccctgcccaagaacatcagctacaccctgctgccccccagcagcaacgtgagaaccgtggtggccaccgtgctggccaccgacagcgacgacggcatcaacgccgacctgaactacagcatcgtgggcggcaaccccttcaagctgttcgagatcgaccccaccagcggcgtggtgagcctggtgggcaagctgacccagaagcactacggcctgcacagactggtggtgcaggtgaacgacagcggccagcccagccagagcaccaccaccctggtgcacgtgttcgtgaacgagagcgtgagcaacgccaccgccatcgacagccagatcgccagaagcctgcacatccccctgacccaggacatcgccggcgaccccagctacgagatcagcaagcagagactgagcatcgtgatcggcgtggtggccggcatcatgaccgtgatcctgatcatcctgatcgtggtgatggccagatactgcagaagcaagaacaagaacggctacgaggccggcaagaaggaccacgaggacttcttcaccccccagcagcacgacaagagcaagaagcccaagaaggacaagaagaacaagaagagcaagcagcccctgtacagcagcatcgtgaccgtggaggccagcaagcccaacggccagagatacgacagcgtgaacgagaagctgagcgacagccccagcatgggcagatacagaagcgtgaacggcggccccggcagccccgacctggccagacactacaagagcagcagccccctgcccaccgtgcagctgcacccccagagccccaccgccggcaagaagcaccaggccgtgcaggacctgccccccgccaacaccttcgtgggcgccggcgacaacatcagcatcggcagcgaccactgcagcgagtacagctgccagaccaacaacaagtacagcaagcagatgagactgcacccctacatcaccgtgttcggctag

SEQ ID NO: 95683 - DNA, 3768 bp, Artificial Sequence
  Description of Artificial Sequence: Synthetic coding sequence
atgctgagaatgagaaccgccggctgggccagaggctggtgcctgggctgctgcctgctgctgcccctgagcctgagcctggccgccgccaagcagctgctgagatacagactggccgaggagggccccgccgacgtgagaatcggcaacgtggccagcgacctgggcatcgtgaccggcagcggcgaggtgaccttcagcctggagagcggcagcgagtacctgaagatcgacaacctgaccggcgagctgagcaccagcgagagaagaatcgacagagagaagctgccccagtgccagatgatcttcgacgagaacgagtgcttcctggacttcgaggtgagcgtgatcggccccagccagagctgggtggacctgttcgagggccaggtgatcgtgctggacatcaacgacaacacccccaccttccccagccccgtgctgaccctgaccgtggaggagaacagacccgtgggcaccctgtacctgctgcccaccgccaccgacagagacttcggcagaaacggcatcgagagatacgagctgctgcaggagcccggcggcggcggcagcggcggcgagagcagaagagccggcgccgccgacagcgccccctaccccggcggcggcggcaacggcgccagcggcggcggcagcggcggcagcaagagaagactggacgccagcgagggcggcggcggcaccaaccccggcggcagaagcagcgtgttcgagctgcaggtggccgacacccccgacggcgagaagcagccccagctgatcgtgaagggcgccctggacagagagcagagagacagctacgagctgaccctgagagtgagagacggcggcgacccccccagaagcagccaggccatcctgagagtgctgatcaccgacgtgaacgacaacagccccagattcgagaagagcgtgtacgaggccgacctggccgagaacagcgcccccggcacccccatcctgcagctgagagccgccgacctggacgtgggcgtgaacggccagatcgagtacgtgttcggcgccgccaccgagagcgtgagaagactgctgagactggacgagaccagcggctggctgagcgtgctgcacagaatcgacagagaggaggtgaaccagctgagattcaccgtgatggccagagacagaggccagccccccaagaccgacaaggccaccgtggtgctgaacatcaaggacgagaacgacaacgtgcccagcatcgagatcagaaagatcggcagaatccccctgaaggacggcgtggccaacgtggccgaggacgtgctggtggacacccccatcgccctggtgcaggtgagcgacagagaccagggcgagaacggcgtggtgacctgcaccgtggtgggcgacgtgcccttccagctgaagcccgccagcgacaccgagggcgaccagaacaagaagaagtacttcctgcacaccagcacccccctggactacgaggccaccagagagttcaacgtggtgatcgtggccgtggacagcggcagccccagcctgagcagcaacaacagcctgatcgtgaaggtgggcgacaccaacgacaacccccccatgttcggccagagcgtggtggaggtgtacttccccgagaacaacatccccggcgagagagtggccaccgtgctggccaccgacgccgacagcggcaagaacgccgagatcgcctacagcctggacagcagcgtgatgggcatcttcgccatcgaccccgacagcggcgacatcctggtgaacaccgtgctggacagagagcagaccgacagatacgagttcaaggtgaacgccaaggacaagggcatccccgtgctgcagggcagcaccaccgtgatcgtgcaggtggccgacaagaacgacaacgaccccaagttcatgcaggacgtgttcaccttctacgtgaaggagaacctgcagcccaacagccccgtgggcatggtgaccgtgatggacgccgacaagggcagaaacgccgagatgagcctgtacatcgaggagaacaacaacatcttcagcatcgagaacgacaccggcaccatctacagcaccatgagcttcgacagagagcaccagaccacctacaccttcagagtgaaggccgtggacggcggcgacccccccagaagcgccaccgccaccgtgagcctgttcgtgatggacgagaacgacaacgcccccaccgtgaccctgcccaagaacatcagctacaccctgctgccccccagcagcaacgtgagaaccgtggtggccaccgtgctggccaccgacagcgacgacggcatcaacgccgacctgaactacagcatcgtgggcggcaaccccttcaagctgttcgagatcgaccccaccagcggcgtggtgagcctggtgggcaagctgacccagaagcactacggcctgcacagactggtggtgcaggtgaacgacagcggccagcccagccagagcaccaccaccctggtgcacgtgttcgtgaacgagagcgtgagcaacgccaccgccatcgacagccagatcgccagaagcctgcacatccccctgacccaggacatcgccggcgaccccagctacgagatcagcaagcagagactgagcatcgtgatcggcgtggtggccggcatcatgaccgtgatcctgatcatcctgatcgtggtgatggccagatactgcagaagcaagaacaagaacggctacgaggccggcaagaaggaccacgaggacttcttcaccccccagcagcacgacaagagcaagaagcccaagaaggacaagaagaacaagaagagcaagcagcccctgtacagcagcatcgtgaccgtggaggccagcaagcccaacggccagagatacgacagcgtgaacgagaagctgagcgacagccccagcatgggcagatacagaagcgtgaacggcggccccggcagccccgacctggccagacactacaagagcagcagccccctgcccaccgtgcagctgcacccccagagccccaccgccggcaagaagcaccaggccgtgcaggacctgccccccgccaacaccttcgtgggcgccggcgacaacatcagcatcggcagcgaccactgcagcgagtacagctgccagaccaacaacaagtacagcaagcagcccttcagaagagtgaccttcagcgtggtgagccagccccaggacccccaccagggcagcctgcagagctgctacgacagcggcctggaggagagcgagacccccagcagcaagagcagcagcggccccagactgggcgccctgcccctgcccgaggacaactacgagagaaccacccccgacggcagcgtgggcgaggccgagcacatggagaacgacagcagacccctgcccgacgtggccctgaccggcaagtgcaccagagagtgcgacgagtacggccacagcgacagctgctggatgcccgtgagaaccagccccgagagaaagaagagccagcccaagctgagcaccttcatgcccgtggacgagagaggcagccaggagaagctggccaacggcgaggccgccatcatgggcgacagaaacagaaacctgctgaacaagaagctgaccagcagctacgagaccttcagcgccgccagcttcagcaagaacgaggaggccaaccccgaggacatccccctgaccaagaccggcgagtacaagcccagccccgtgaacaccctgaccagaagagaggtgtacctgtag

SEQ ID NO: 95684 - DNA, 2922 bp, Artificial Sequence
  Description of Artificial Sequence: Synthetic coding sequence
atgagccccgtgagaagatggggcagcccctgcctgttccccctgcagctgttcagcctgtgctgggtgctgagcgtggcccagagcaagaccgtgagatacagcaccttcgaggaggacgcccccggcaccgtgatcggcaccctggccgaggacctgcacatgaaggtgagcggcgacaccagcttcagactgatgaagcagttcaacagcagcctgctgagagtgagagagggcgacggccagctgaccgtgggcgacgccggcctggacagagagagactgtgcggccaggccccccagtgcgtgctggccttcgacgtggtgagcttcagccaggagcagttcagactggtgcacgtggaggtggaggtgagagacgtgaacgaccacgcccccagattccccagagcccagatccccgtggaggtgagcgagggcgccgccgtgggcaccagaatccccctggaggtgcccgtggacgaggacgtgggcgccaacggcctgcagaccgtgagactggccgagccccacagccccttcagagtggagctgcagaccagagccgacggcgcccagtgcgccgacctggtgctgctgcaggagctggacagagagagccaggccgcctacagcctggagctggtggcccaggacggcggcagaccccccagaagcgccaccgccgccctgagcgtgagagtgctggacgccaacgaccacagccccgccttcccccagggcgccgtggccgaggtggagctggccgaggacgcccccgtgggcagcctgctgctggacctggacgccgccgaccccgacgagggccccaacggcgacgtggtgttcgccttcggcgccagaaccccccccgaggccagaagactgttcagactggaccccagaagcggcagactgaccctggccggccccgtggactacgagagacaggacacctacgagctggacgtgagagcccaggacagaggccccggccccagagccgccacctgcaaggtgatcgtgagaatcagagacgtgaacgacaacgcccccgacatcgccatcacccccctggccgcccccggcgcccccgccaccagccccttcgccgccgccgccgccgccgccgccctgggcggcgccgacgccagcagccccgccggcgccggcacccccgaggccggcgccaccagcctggtgcccgagggcgccgccagagagagcctggtggccctggtgagcaccagcgacagagacagcggcgccaacggccaggtgagatgcgccctgtacggccacgagcacttcagactgcagcccgcctacgccggcagctacctggtggtgaccgccgccagcctggacagagagagaatcgccgagtacaacctgaccctggtggccgaggacagaggcgccccccccctgagaaccgtgagaccctacaccgtgagagtgggcgacgagaacgacaacgcccccctgttcaccagacccgtgtacgaggtgagcgtgagagagaacaacccccccggcgcctacctggccaccgtggccgccagagacagagacctgggcagaaacggccaggtgacctacagactgctggaggccgaggtgggcagagccggcggcgccgtgagcacctacgtgagcgtggaccccgccaccggcgccatctacgccctgagaagcttcgactacgagaccctgagacagctggacgtgagaatccaggccagcgacggcggcagcccccagctgagcagcagcgccctggtgcaggtgagagtgctggaccagaacgaccacgcccccgtgctggtgcaccccgcccccgccaacggcagcctggaggtggccgtgcccggcagaaccgccaaggacaccgtggtggccagagtgcaggccagagacgccgacgagggcgccaacggcgagctggccttcgagctgcagcagcaggagcccagagaggccttcgccatcggcagaagaaccggcgagatcctgctgaccggcgacctgagccaggagccccccggcagagtgttcagagccctgctggtgatcagcgacggcggcagaccccccctgaccaccaccgccaccgtgagcttcgtggtgaccgccggcggcggcagaggccccgccgcccccgccagcgccggcagccccgagagaagcagaccccccggcagcagactgggcgtgagcggcagcgtgctgcagtgggacacccccctgatcgtgatcatcgtgctggccggcagctgcaccctgctgctggccgccatcatcgccatcgccaccacctgcaacagaagaaagaaggagccctacggcgccagccccggcttcggcaaggagcccgccccccccgtggccgtgtggaagggccacagcttcaacaccatcagcggcagagaggccgagaagttcagcggcaaggacagcggcaagggcgacagcgacttcaacgacagcgacagcgacatcagcggcgacgccctgaagaaggacctgatcaaccacatgcagagcggcctgtgggcctgcaccgccgagtgcaagatcctgggccacagcgacagatgctggagccccagctgcagcggccccaacgcccaccccagcccccacccccccgcccagatgagcaccttctgcaagagcaccagcctgcccagagaccccctgagaagagacaactactaccaggcccagctgcccaagaccgtgggcctgcagagcgtgtacgagaaggtgctgcacagagactacgacagaaccgtgaccctgctgagcccccccagacccggcagactgcccgacctgcaggagatcggcgtgcccctgtaccagagcccccccggcagatacctgagccccaagaagggcgccaacgagaacgtgtag

SEQ ID NO: 95685 - DNA, 3213 bp, Artificial Sequence
  Description of Artificial Sequence: Synthetic coding sequence
atgagccccgtgagaagatggggcagcccctgcctgttccccctgcagctgttcagcctgtgctgggtgctgagcgtggcccagagcaagaccgtgagatacagcaccttcgaggaggacgcccccggcaccgtgatcggcaccctggccgaggacctgcacatgaaggtgagcggcgacaccagcttcagactgatgaagcagttcaacagcagcctgctgagagtgagagagggcgacggccagctgaccgtgggcgacgccggcctggacagagagagactgtgcggccaggccccccagtgcgtgctggccttcgacgtggtgagcttcagccaggagcagttcagactggtgcacgtggaggtggaggtgagagacgtgaacgaccacgcccccagattccccagagcccagatccccgtggaggtgagcgagggcgccgccgtgggcaccagaatccccctggaggtgcccgtggacgaggacgtgggcgccaacggcctgcagaccgtgagactggccgagccccacagccccttcagagtggagctgcagaccagagccgacggcgcccagtgcgccgacctggtgctgctgcaggagctggacagagagagccaggccgcctacagcctggagctggtggcccaggacggcggcagaccccccagaagcgccaccgccgccctgagcgtgagagtgctggacgccaacgaccacagccccgccttcccccagggcgccgtggccgaggtggagctggccgaggacgcccccgtgggcagcctgctgctggacctggacgccgccgaccccgacgagggccccaacggcgacgtggtgttcgccttcggcgccagaaccccccccgaggccagaagactgttcagactggaccccagaagcggcagactgaccctggccggccccgtggactacgagagacaggacacctacgagctggacgtgagagcccaggacagaggccccggccccagagccgccacctgcaaggtgatcgtgagaatcagagacgtgaacgacaacgcccccgacatcgccatcacccccctggccgcccccggcgcccccgccaccagccccttcgccgccgccgccgccgccgccgccctgggcggcgccgacgccagcagccccgccggcgccggcacccccgaggccggcgccaccagcctggtgcccgagggcgccgccagagagagcctggtggccctggtgagcaccagcgacagagacagcggcgccaacggccaggtgagatgcgccctgtacggccacgagcacttcagactgcagcccgcctacgccggcagctacctggtggtgaccgccgccagcctggacagagagagaatcgccgagtacaacctgaccctggtggccgaggacagaggcgccccccccctgagaaccgtgagaccctacaccgtgagagtgggcgacgagaacgacaacgcccccctgttcaccagacccgtgtacgaggtgagcgtgagagagaacaacccccccggcgcctacctggccaccgtggccgccagagacagagacctgggcagaaacggccaggtgacctacagactgctggaggccgaggtgggcagagccggcggcgccgtgagcacctacgtgagcgtggaccccgccaccggcgccatctacgccctgagaagcttcgactacgagaccctgagacagctggacgtgagaatccaggccagcgacggcggcagcccccagctgagcagcagcgccctggtgcaggtgagagtgctggaccagaacgaccacgcccccgtgctggtgcaccccgcccccgccaacggcagcctggaggtggccgtgcccggcagaaccgccaaggacaccgtggtggccagagtgcaggccagagacgccgacgagggcgccaacggcgagctggccttcgagctgcagcagcaggagcccagagaggccttcgccatcggcagaagaaccggcgagatcctgctgaccggcgacctgagccaggagccccccggcagagtgttcagagccctgctggtgatcagcgacggcggcagaccccccctgaccaccaccgccaccgtgagcttcgtggtgaccgccggcggcggcagaggccccgccgcccccgccagcgccggcagccccgagagaagcagaccccccggcagcagactgggcgtgagcggcagcgtgctgcagtgggacacccccctgatcgtgatcatcgtgctggccggcagctgcaccctgctgctggccgccatcatcgccatcgccaccacctgcaacagaagaaagaaggaggtgagaaagggcggcgccctgagagaggagagacccggcgccgccggcggcggcgccagcgcccccggcagccccgaggaggccgccagaggcgccggccccagacccaacatgttcgacgtgctgaccttccccggcaccggcaaggcccccttcggcagccccgccgccgacgcccccccccccgccgtggccgccgccgaggtgcccggcagcgagggcggcagcgccaccggcgagagcgcctgccacttcgagggccagcagagactgagaggcgcccacgccgagccctacggcgccagccccggcttcggcaaggagcccgccccccccgtggccgtgtggaagggccacagcttcaacaccatcagcggcagagaggccgagaagttcagcggcaaggacagcggcaagggcgacagcgacttcaacgacagcgacagcgacatcagcggcgacgccctgaagaaggacctgatcaaccacatgcagagcggcctgtgggcctgcaccgccgagtgcaagatcctgggccacagcgacagatgctggagccccagctgcagcggccccaacgcccaccccagcccccacccccccgcccagatgagcaccttctgcaagagcaccagcctgcccagagaccccctgagaagagacaactactaccaggcccagctgcccaagaccgtgggcctgcagagcgtgtacgagaaggtgctgcacagagactacgacagaaccgtgaccctgctgagcccccccagacccggcagactgcccgacctgcaggagatcggcgtgcccctgtaccagagcccccccggcagatacctgagccccaagaagggcgccaacgagaacgtgtag

SEQ ID NO: 95686 - DNA, 1791 bp, Artificial Sequence
  Description of Artificial Sequence: Synthetic coding sequence
atgagccccgtgagaagatggggcagcccctgcctgttccccctgcagctgttcagcctgtgctgggtgctgagcgtggcccagagcaagaccgtgagatacagcaccttcgaggaggacgcccccggcaccgtgatcggcaccctggccgaggacctgcacatgaaggtgagcggcgacaccagcttcagactgatgaagcagttcaacagcagcctgctgagagtgagagagggcgacggccagctgaccgtgggcgacgccggcctggacagagagagactgtgcggccaggccccccagtgcgtgctggccttcgacgtggtgagcttcagccaggagcagttcagactggtgcacgtggaggtggaggtgagagacgtgaacgaccacgcccccgtgctggtgcaccccgcccccgccaacggcagcctggaggtggccgtgcccggcagaaccgccaaggacaccgtggtggccagagtgcaggccagagacgccgacgagggcgccaacggcgagctggccttcgagctgcagcagcaggagcccagagaggccttcgccatcggcagaagaaccggcgagatcctgctgaccggcgacctgagccaggagccccccggcagagtgttcagagccctgctggtgatcagcgacggcggcagaccccccctgaccaccaccgccaccgtgagcttcgtggtgaccgccggcggcggcagaggccccgccgcccccgccagcgccggcagccccgagagaagcagaccccccggcagcagactgggcgtgagcggcagcgtgctgcagtgggacacccccctgatcgtgatcatcgtgctggccggcagctgcaccctgctgctggccgccatcatcgccatcgccaccacctgcaacagaagaaagaaggaggtgagaaagggcggcgccctgagagaggagagacccggcgccgccggcggcggcgccagcgcccccggcagccccgaggaggccgccagaggcgccggccccagacccaacatgttcgacgtgctgaccttccccggcaccggcaaggcccccttcggcagccccgccgccgacgcccccccccccgccgtggccgccgccgaggtgcccggcagcgagggcggcagcgccaccggcgagagcgcctgccacttcgagggccagcagagactgagaggcgcccacgccgagccctacggcgccagccccggcttcggcaaggagcccgccccccccgtggccgtgtggaagggccacagcttcaacaccatcagcggcagagaggccgagaagttcagcggcaaggacagcggcaagggcgacagcgacttcaacgacagcgacagcgacatcagcggcgacgccctgaagaaggacctgatcaaccacatgcagagcggcctgtgggcctgcaccgccgagtgcaagatcctgggccacagcgacagatgctggagccccagctgcagcggccccaacgcccaccccagcccccacccccccgcccagatgagcaccttctgcaagagcaccagcctgcccagagaccccctgagaagagacaactactaccaggcccagctgcccaagaccgtgggcctgcagagcgtgtacgagaaggtgctgcacagagactacgacagaaccgtgaccctgctgagcccccccagacccggcagactgcccgacctgcaggagatcggcgtgcccctgtaccagagcccccccggcagatacctgagccccaagaagggcgccaacgagaacgtgtag

SEQ ID NO: 95687 - DNA, 2742 bp, Artificial Sequence
  Description of Artificial Sequence: Synthetic coding sequence
atgagccccgtgagaagatggggcagcccctgcctgttccccctgcagctgttcagcctgtgctgggtgctgagcgtggcccagagcaagaccgtgagatacagcaccttcgaggaggacgcccccggcaccgtgatcggcaccctggccgaggacctgcacatgaaggtgagcggcgacaccagcttcagactgatgaagcagttcaacagcagcctgctgagagtgagagagggcgacggccagctgaccgtgggcgacgccggcctggacagagagagactgtgcggccaggccccccagtgcgtgctggccttcgacgtggtgagcttcagccaggagcagttcagactggtgcacgtggaggtggaggtgagagacgtgaacgaccacgcccccagattccccagagcccagatccccgtggaggtgagcgagggcgccgccgtgggcaccagaatccccctggaggtgcccgtggacgaggacgtgggcgccaacggcctgcagaccgtgagactggccgagccccacagccccttcagagtggagctgcagaccagagccgacggcgcccagtgcgccgacctggtgctgctgcaggagctggacagagagagccaggccgcctacagcctggagctggtggcccaggacggcggcagaccccccagaagcgccaccgccgccctgagcgtgagagtgctggacgccaacgaccacagccccgccttcccccagggcgccgtggccgaggtggagctggccgaggacgcccccgtgggcagcctgctgctggacctggacgccgccgaccccgacgagggccccaacggcgacgtggtgttcgccttcggcgccagaaccccccccgaggccagaagactgttcagactggaccccagaagcggcagactgaccctggccggccccgtggactacgagagacaggacacctacgagctggacgtgagagcccaggacagaggccccggccccagagccgccacctgcaaggtgatcgtgagaatcagagacgtgaacgacaacgcccccgacatcgccatcacccccctggccgcccccggcgccggcaacctgaccctgagaagaaacggccaggtgacctacagactgctggaggccgaggtgggcagagccggcggcgccgtgagcacctacgtgagcgtggaccccgccaccggcgccatctacgccctgagaagcttcgactacgagaccctgagacagctggacgtgagaatccaggccagcgacggcggcagcccccagctgagcagcagcgccctggtgcaggtgagagtgctggaccagaacgaccacgcccccgtgctggtgcaccccgcccccgccaacggcagcctggaggtggccgtgcccggcagaaccgccaaggacaccgtggtggccagagtgcaggccagagacgccgacgagggcgccaacggcgagctggccttcgagctgcagcagcaggagcccagagaggccttcgccatcggcagaagaaccggcgagatcctgctgaccggcgacctgagccaggagccccccggcagagtgttcagagccctgctggtgatcagcgacggcggcagaccccccctgaccaccaccgccaccgtgagcttcgtggtgaccgccggcggcggcagaggccccgccgcccccgccagcgccggcagccccgagagaagcagaccccccggcagcagactgggcgtgagcggcagcgtgctgcagtgggacacccccctgatcgtgatcatcgtgctggccggcagctgcaccctgctgctggccgccatcatcgccatcgccaccacctgcaacagaagaaagaaggaggtgagaaagggcggcgccctgagagaggagagacccggcgccgccggcggcggcgccagcgcccccggcagccccgaggaggccgccagaggcgccggccccagacccaacatgttcgacgtgctgaccttccccggcaccggcaaggcccccttcggcagccccgccgccgacgcccccccccccgccgtggccgccgccgaggtgcccggcagcgagggcggcagcgccaccggcgagagcgcctgccacttcgagggccagcagagactgagaggcgcccacgccgagccctacggcgccagccccggcttcggcaaggagcccgccccccccgtggccgtgtggaagggccacagcttcaacaccatcagcggcagagaggccgagaagttcagcggcaaggacagcggcaagggcgacagcgacttcaacgacagcgacagcgacatcagcggcgacgccctgaagaaggacctgatcaaccacatgcagagcggcctgtgggcctgcaccgccgagtgcaagatcctgggccacagcgacagatgctggagccccagctgcagcggccccaacgcccaccccagcccccacccccccgcccagatgagcaccttctgcaagagcaccagcctgcccagagaccccctgagaagagacaactactaccaggcccagctgcccaagaccgtgggcctgcagagcgtgtacgagaaggtgctgcacagagactacgacagaaccgtgaccctgctgagcccccccagacccggcagactgcccgacctgcaggagatcggcgtgcccctgtaccagagcccccccggcagatacctgagccccaagaagggcgccaacgagaacgtgtag

SEQ ID NO: 95688 - DNA, 3612 bp, Artificial Sequence
  Description of Artificial Sequence: Synthetic coding sequence
atggacctgagagacttctacctgctggccgccctgatcgcctgcctgagactggacagcgccatcgcccaggagctgatctacaccatcagagaggagctgcccgagaacgtgcccatcggcaacatccccaaggacctgaacatcagccacatcaacgccgccaccggcaccagcgccagcctggtgtacagactggtgagcaaggccggcgacgcccccctggtgaaggtgagcagcagcaccggcgagatcttcaccaccagcaacagaatcgacagagagaagctgtgcgccggcgccagctacgccgaggagaacgagtgcttcttcgagctggaggtggtgatcctgcccaacgacttcttcagactgatcaagatcaagatcatcgtgaaggacaccaacgacaacgcccccatgttccccagccccgtgatcaacatcagcatccccgagaacaccctgatcaacagcagattccccatccccagcgccaccgaccccgacaccggcttcaacggcgtgcagcactacgagctgctgaacggccagagcgtgttcggcctggacatcgtggagacccccgagggcgagaagtggccccagctgatcgtgcagcagaacctggacagagagcagaaggacacctacgtgatgaagatcaaggtggaggacggcggcaccccccagaagagcagcaccgccatcctgcaggtgaccgtgagcgacgtgaacgacaacagacccgtgttcaaggagggccaggtggaggtgcacatccccgagaacgcccccgtgggcaccagcgtgatccagctgcacgccaccgacgccgacatcggcagcaacgccgagatcagatacatcttcggcgcccaggtggcccccgccaccaagagactgttcgccctgaacaacaccaccggcctgatcaccgtgcagagaagcctggacagagaggagaccgccatccacaaggtgaccgtgctggccagcgacggcagcagcacccccgccagagccaccgtgaccatcaacgtgaccgacgtgaacgacaacccccccaacatcgacctgagatacatcatcagccccatcaacggcaccgtgtacctgagcgagaaggaccccgtgaacaccaagatcgccctgatcaccgtgagcgacaaggacaccgacgtgaacggcaaggtgatctgcttcatcgagagagaggtgcccttccacctgaaggccgtgtacgacaaccagtacctgctggagaccagcagcctgctggactacgagggcaccaaggagttcagcttcaagatcgtggccagcgacagcggcaagcccagcctgaaccagaccgccctggtgagagtgaagctggaggacgagaacgacaacccccccatcttcaaccagcccgtgatcgagctgagcgtgagcgagaacaacagaagaggcctgtacctgaccaccatcagcgccaccgacgaggacagcggcaagaacgccgacatcgtgtaccagctgggccccaacgccagcttcttcgacctggacagaaagaccggcgtgctgaccgccagcagagtgttcgacagagaggagcaggagagattcatcttcaccgtgaccgccagagacaacggcaccccccccctgcagagccaggccgccgtgatcgtgaccgtgctggacgagaacgacaacagccccaagttcacccacaaccacttccagttcttcgtgagcgagaacctgcccaagtacagcaccgtgggcgtgatcaccgtgaccgacgccgacgccggcgagaacaaggccgtgaccctgagcatcctgaacgacaacgacaacttcgtgctggacccctacagcggcgtgatcaagagcaacgtgagcttcgacagagagcagcagagcagctacaccttcgacgtgaaggccaccgacggcggccagccccccagaagcagcaccgccaaggtgaccatcaacgtgatggacgtgaacgacaacagccccgtggtgatcagcccccccagcaacaccagcttcaagctggtgcccctgagcgccatccccggcagcgtggtggccgaggtgttcgccgtggacgtggacaccggcatgaacgccgagctgaagtacaccatcgtgagcggcaacaacaagggcctgttcagaatcgaccccgtgaccggcaacatcaccctggaggagaagcccgcccccaccgacgtgggcctgcacagactggtggtgaacatcagcgacctgggctaccccaagagcctgcacaccctggtgctggtgttcctgtacgtgaacgacaccgccggcaacgccagctacatctacgacctgatcagaagaaccatggagacccccctggacagaaacatcggcgacagcagccagccctaccagaacgaggactacctgaccatcatgatcgccatcatcgccggcgccatggtggtgatcgtggtgatcttcgtgaccgtgctggtgagatgcagacacgccagcagattcaaggccgcccagagaagcaagcagggcgccgagtggatgagccccaaccaggagaacaagcagaacaagaagaagaagagaaagaagagaaagagccccaagagcagcctgctgaacttcgtgaccatcgaggagagcaagcccgacgacgccgtgcacgagcccatcaacggcaccatcagcctgcccgccgagctggaggagcagagcatcggcagattcgactggggccccgccccccccaccaccttcaagcccaacagccccgacctggccaagcactacaagagcgccagcccccagcccgccttccacctgaagcccgacacccccgtgagcgtgaagaagcaccacgtgatccaggagctgcccctggacaacaccttcgtgggcggctgcgacaccctgagcaagagaagcagcaccagcagcgaccacttcagcgccagcgagtgcagcagccagggcggcttcaagaccaagggccccctgcacaccagacagagccagagaagagtgaccttccacctgcccgacggcagccaggagagctgcagcgacagcggcctgggcgaccacgagcccgtgggcagcggcaccctgatcagccaccccctgcccctggtgcagccccaggacgagttctacgaccaggccagccccgacaagagaaccgaggccgacggcaacagcgaccccaacagcgacggccccctgggccccagaggcctggccgaggccaccgagatgtgcacccaggagtgcctggtgctgggccacagcgacaactgctggatgccccccggcctgggcccctaccagcaccccaagagccccctgagcaccttcgccccccagaaggagtgggtgaagaaggacaagctggtgaacggccacaccctgaccagagcctggaaggaggacagcaacagaaaccagttcaacgacagaaagcagtacggcagcaacgagggccacttcaacaacggcagccacatgaccgacatccccctggccaacctgaagagctacaagcaggccggcggcgccaccgagagccccaaggagcaccagctgtag

SEQ ID NO: 95689 - DNA, 3099 bp, Artificial Sequence
  Description of Artificial Sequence: Synthetic coding sequence
atggacctgagagacttctacctgctggccgccctgatcgcctgcctgagactggacagcgccatcgcccaggagctgatctacaccatcagagaggagctgcccgagaacgtgcccatcggcaacatccccaaggacctgaacatcagccacatcaacgccgccaccggcaccagcgccagcctggtgtacagactggtgagcaaggccggcgacgcccccctggtgaaggtgagcagcagcaccggcgagatcttcaccaccagcaacagaatcgacagagagaagctgtgcgccggcgccagctacgccgaggagaacgagtgcttcttcgagctggaggtggtgatcctgcccaacgacttcttcagactgatcaagatcaagatcatcgtgaaggacaccaacgacaacgcccccatgttccccagccccgtgatcaacatcagcatccccgagaacaccctgatcaacagcagattccccatccccagcgccaccgaccccgacaccggcttcaacggcgtgcagcactacgagctgctgaacggccagagcgtgttcggcctggacatcgtggagacccccgagggcgagaagtggccccagctgatcgtgcagcagaacctggacagagagcagaaggacacctacgtgatgaagatcaaggtggaggacggcggcaccccccagaagagcagcaccgccatcctgcaggtgaccgtgagcgacgtgaacgacaacagacccgtgttcaaggagggccaggtggaggtgcacatccccgagaacgcccccgtgggcaccagcgtgatccagctgcacgccaccgacgccgacatcggcagcaacgccgagatcagatacatcttcggcgcccaggtggcccccgccaccaagagactgttcgccctgaacaacaccaccggcctgatcaccgtgcagagaagcctggacagagaggagaccgccatccacaaggtgaccgtgctggccagcgacggcagcagcacccccgccagagccaccgtgaccatcaacgtgaccgacgtgaacgacaacccccccaacatcgacctgagatacatcatcagccccatcaacggcaccgtgtacctgagcgagaaggaccccgtgaacaccaagatcgccctgatcaccgtgagcgacaaggacaccgacgtgaacggcaaggtgatctgcttcatcgagagagaggtgcccttccacctgaaggccgtgtacgacaaccagtacctgctggagaccagcagcctgctggactacgagggcaccaaggagttcagcttcaagatcgtggccagcgacagcggcaagcccagcctgaaccagaccgccctggtgagagtgaagctggaggacgagaacgacaacccccccatcttcaaccagcccgtgatcgagctgagcgtgagcgagaacaacagaagaggcctgtacctgaccaccatcagcgccaccgacgaggacagcggcaagaacgccgacatcgtgtaccagctgggccccaacgccagcttcttcgacctggacagaaagaccggcgtgctgaccgccagcagagtgttcgacagagaggagcaggagagattcatcttcaccgtgaccgccagagacaacggcaccccccccctgcagagccaggccgccgtgatcgtgaccgtgctggacgagaacgacaacagccccaagttcacccacaaccacttccagttcttcgtgagcgagaacctgcccaagtacagcaccgtgggcgtgatcaccgtgaccgacgccgacgccggcgagaacaaggccgtgaccctgagcatcctgaacgacaacgacaacttcgtgctggacccctacagcggcgtgatcaagagcaacgtgagcttcgacagagagcagcagagcagctacaccttcgacgtgaaggccaccgacggcggccagccccccagaagcagcaccgccaaggtgaccatcaacgtgatggacgtgaacgacaacagccccgtggtgatcagcccccccagcaacaccagcttcaagctggtgcccctgagcgccatccccggcagcgtggtggccgaggtgttcgccgtggacgtggacaccggcatgaacgccgagctgaagtacaccatcgtgagcggcaacaacaagggcctgttcagaatcgaccccgtgaccggcaacatcaccctggaggagaagcccgcccccaccgacgtgggcctgcacagactggtggtgaacatcagcgacctgggctaccccaagagcctgcacaccctggtgctggtgttcctgtacgtgaacgacaccgccggcaacgccagctacatctacgacctgatcagaagaaccatggagacccccctggacagaaacatcggcgacagcagccagccctaccagaacgaggactacctgaccatcatgatcgccatcatcgccggcgccatggtggtgatcgtggtgatcttcgtgaccgtgctggtgagatgcagacacgccagcagattcaaggccgcccagagaagcaagcagggcgccgagtggatgagccccaaccaggagaacaagcagaacaagaagaagaagagaaagaagagaaagagccccaagagcagcctgctgaacttcgtgaccatcgaggagagcaagcccgacgacgccgtgcacgagcccatcaacggcaccatcagcctgcccgccgagctggaggagcagagcatcggcagattcgactggggccccgccccccccaccaccttcaagcccaacagccccgacctggccaagcactacaagagcgccagcccccagcccgccttccacctgaagcccgacacccccgtgagcgtgaagaagcaccacgtgatccaggagctgcccctggacaacaccttcgtgggcggctgcgacaccctgagcaagagaagcagcaccagcagcgaccacttcagcgccagcgagtgcagcagccagggcggcttcaagaccaagggccccctgcacaccagacaggtgaacgagcacttctactggagcatcagcaccgcctacaagtgccccgtgaaccagtactag

SEQ ID NO: 95690 - DNA, 3714 bp, Artificial Sequence
  Description of Artificial Sequence: Synthetic coding sequence
atggacctgagagacttctacctgctggccgccctgatcgcctgcctgagactggacagcgccatcgcccaggagctgatctacaccatcagagaggagctgcccgagaacgtgcccatcggcaacatccccaaggacctgaacatcagccacatcaacgccgccaccggcaccagcgccagcctggtgtacagactggtgagcaaggccggcgacgcccccctggtgaaggtgagcagcagcaccggcgagatcttcaccaccagcaacagaatcgacagagagaagctgtgcgccggcgccagctacgccgaggagaacgagtgcttcttcgagctggaggtggtgatcctgcccaacgacttcttcagactgatcaagatcaagatcatcgtgaaggacaccaacgacaacgcccccatgttccccagccccgtgatcaacatcagcatccccgagaacaccctgatcaacagcagattccccatccccagcgccaccgaccccgacaccggcttcaacggcgtgcagcactacgagctgctgaacggccagagcgtgttcggcctggacatcgtggagacccccgagggcgagaagtggccccagctgatcgtgcagcagaacctggacagagagcagaaggacacctacgtgatgaagatcaaggtggaggacggcggcaccccccagaagagcagcaccgccatcctgcaggtgaccgtgagcgacgtgaacgacaacagacccgtgttcaaggagggccaggtggaggtgcacatccccgagaacgcccccgtgggcaccagcgtgatccagctgcacgccaccgacgccgacatcggcagcaacgccgagatcagatacatcttcggcgcccaggtggcccccgccaccaagagactgttcgccctgaacaacaccaccggcctgatcaccgtgcagagaagcctggacagagaggagaccgccatccacaaggtgaccgtgctggccagcgacggcagcagcacccccgccagagccaccgtgaccatcaacgtgaccgacgtgaacgacaacccccccaacatcgacctgagatacatcatcagccccatcaacggcaccgtgtacctgagcgagaaggaccccgtgaacaccaagatcgccctgatcaccgtgagcgacaaggacaccgacgtgaacggcaaggtgatctgcttcatcgagagagaggtgcccttccacctgaaggccgtgtacgacaaccagtacctgctggagaccagcagcctgctggactacgagggcaccaaggagttcagcttcaagatcgtggccagcgacagcggcaagcccagcctgaaccagaccgccctggtgagagtgaagctggaggacgagaacgacaacccccccatcttcaaccagcccgtgatcgagctgagcgtgagcgagaacaacagaagaggcctgtacctgaccaccatcagcgccaccgacgaggacagcggcaagaacgccgacatcgtgtaccagctgggccccaacgccagcttcttcgacctggacagaaagaccggcgtgctgaccgccagcagagtgttcgacagagaggagcaggagagattcatcttcaccgtgaccgccagagacaacggcaccccccccctgcagagccaggccgccgtgatcgtgaccgtgctggacgagaacgacaacagccccaagttcacccacaaccacttccagttcttcgtgagcgagaacctgcccaagtacagcaccgtgggcgtgatcaccgtgaccgacgccgacgccggcgagaacaaggccgtgaccctgagcatcctgaacgacaacgacaacttcgtgctggacccctacagcggcgtgatcaagagcaacgtgagcttcgacagagagcagcagagcagctacaccttcgacgtgaaggccaccgacggcggccagccccccagaagcagcaccgccaaggtgaccatcaacgtgatggacgtgaacgacaacagccccgtggtgatcagcccccccagcaacaccagcttcaagctggtgcccctgagcgccatccccggcagcgtggtggccgaggtgttcgccgtggacgtggacaccggcatgaacgccgagctgaagtacaccatcgtgagcggcaacaacaagggcctgttcagaatcgaccccgtgaccggcaacatcaccctggaggagaagcccgcccccaccgacgtgggcctgcacagactggtggtgaacatcagcgacctgggctaccccaagagcctgcacaccctggtgctggtgttcctgtacgtgaacgacaccgccggcaacgccagctacatctacgacctgatcagaagaaccatggagacccccctggacagaaacatcggcgacagcagccagccctaccagaacgaggactacctgaccatcatgatcgccatcatcgccggcgccatggtggtgatcgtggtgatcttcgtgaccgtgctggtgagatgcagacacgccagcagattcaaggccgcccagagaagcaagcagggcgccgagtggatgagccccaaccaggagaacaagcagaacaagaagaagaagagaaagaagagaaagagccccaagagcagcctgctgaacttcgtgaccatcgaggagagcaagcccgacgacgccgtgcacgagcccatcaacggcaccatcagcctgcccgccgagctggaggagcagagcatcggcagattcgactggggccccgccccccccaccaccttcaagcccaacagccccgacctggccaagcactacaagagcgccagcccccagcccgccttccacctgaagcccgacacccccgtgagcgtgaagaagcaccacgtgatccaggagctgcccctggacaacaccttcgtgggcggctgcgacaccctgagcaagagaagcagcaccagcagcgaccacttcagcgccagcgagtgcagcagccagggcggcttcaagaccaagggccccctgcacaccagacagtgcaacagccacagcaagagcgacaacatccccgtgaccccccagaagtgccccagcagcaccggcttccacatccaggagaacgaggagagccactacgagagccagagaagagtgaccttccacctgcccgacggcagccaggagagctgcagcgacagcggcctgggcgaccacgagcccgtgggcagcggcaccctgatcagccaccccctgcccctggtgcagccccaggacgagttctacgaccaggccagccccgacaagagaaccgaggccgacggcaacagcgaccccaacagcgacggccccctgggccccagaggcctggccgaggccaccgagatgtgcacccaggagtgcctggtgctgggccacagcgacaactgctggatgccccccggcctgggcccctaccagcaccccaagagccccctgagcaccttcgccccccagaaggagtgggtgaagaaggacaagctggtgaacggccacaccctgaccagagcctggaaggaggacagcaacagaaaccagttcaacgacagaaagcagtacggcagcaacgagggccacttcaacaacggcagccacatgaccgacatccccctggccaacctgaagagctacaagcaggccggcggcgccaccgagagccccaaggagcaccagctgtag

SEQ ID NO: 95691 - DNA, 3612 bp, Artificial Sequence; identical to SEQ ID NO: 95688
  Description of Artificial Sequence: Synthetic coding sequence

SEQ ID NO: 95692 - DNA, 3714 bp, Artificial Sequence; identical to SEQ ID NO: 95690
  Description of Artificial Sequence: Synthetic coding sequence

SEQ ID NO: 95693 - DNA, 2424 bp, Artificial Sequence
  Description of Artificial Sequence: Synthetic coding sequence
atggtgttcagcagaagaggcggcctgggcgccagagacctgctgctgtggctgctgctgctggccgcctgggaggtgggcagcggccagctgcactacagcatccccgaggaggccaagcacggcaccttcgtgggcagagtggcccaggacctgggcctggagctggccgagctggtgcccagactgttcagagtggccagcaagacccacagagacctgctggaggtgaacctgcagaacggcatcctgttcgtgaacagcagaatcgacagagaggagctgtgccagtggagcgccgagtgcagcatccacctggagctgatcgccgacagacccctgcaggtgttccacgtggaggtgaaggtgaaggacatcaacgacaacccccccgtgttcagaggcagagagcagatcatcttcatccccgagagcagactgctgaacagcagattccccatcgagggcgccgccgacgccgacatcggcgccaacgccctgctgacctacaccctgagccccagcgactacttcagcctggacgtggaggccagcgacgagctgagcaagagcctgtggctggagctgagaaagtacctggacagagaggagacccccgagctgcacctgctgctgaccgccaccgacggcggcaagcccgagctgcagggcaccgtggagctgctgatcaccgtgctggacgtgaacgacaacgcccccctgttcgaccaggccgtgtacagagtgcacctgctggagaccaccgccaacggcaccctggtgaccaccctgaacgccagcgacgccgacgagggcgtgaacggcgaggtggtgttcagcttcgacagcggcatcagcagagacatccaggagaagttcaaggtggacagcagcagcggcgagatcagactgatcgacaagctggactacgaggagaccaagagctacgagatccaggtgaaggccgtggacaagggcagcccccccatgagcaaccactgcaaggtgctggtgaaggtgctggacgtgaacgacaacgcccccgagctggccgtgaccagcctgtacctgcccatcagagaggacgcccccctgagcaccgtgatcgccctgatcaccgtgagcgacagagacagcggcgccaacggccaggtgacctgcagcctgatgccccacgtgcccttcaagctggtgagcaccttcaagaactactacagcctggtgctggacagcgccctggacagagagagcctgagcgtgtacgagctggtggtgaccgccagagacggcggcagccccagcctgtgggccaccgccagagtgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcaactacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggcccccagagtgggcggcaccatcggcgccgtgagcgagctggtgcccagactggtgggcgccggccacgtggtggccaaggtgagagccgtggacgccgacagcggctacaacgcctggctgagctacgagctgcagcccgccgccggcggcgccagaatccccttcagagtgggcctgtacaccggcgagatcagcaccaccagagtgctggacgaggccgacctgagcagatacagactgctggtgctggtgaaggaccacggcgagcccgccctgaccgccaccgccaccgtgctggtgagcctggtggagagcggccaggcccccaaggccagcagcagagccagcgtgggcgtggccggccccgaggccgccctggtggacgtgaacgtgtacctgatcatcgccatctgcgccgtgagcagcctgctggtgctgaccctgctgctgtacaccgccctgagatgcagcgtgccccccaccgagggcgcctacgtgcccggcaagcccaccctggtgtgcagcagcgccctgggcagctggagcaacagccagcagagaagacagagagtgtgcagcagcgagggcccccccaagaccgacctgatggccttcagccccggcctgagccccagcctgaacaccagcgagagaaacgagcagcccgaggccaacctggacctgagcggcaacgtgagccccaccttcgagttctggctgtag

SEQ ID NO: 95694 - DNA, 2061 bp, Artificial Sequence
  Description of Artificial Sequence: Synthetic coding sequence
atggtgttcagcagaagaggcggcctgggcgccagagacctgctgctgtggctgctgctgctggccgcctgggaggtgggcagcggccagctgcactacagcatccccgaggaggccaagcacggcaccttcgtgggcagagtggcccaggacctgggcctggagctggccgagctggtgcccagactgttcagagtggccagcaagacccacagagacctgctggaggtgaacctgcagaacggcatcctgttcgtgaacagcagaatcgacagagaggagctgtgccagtggagcgccgagtgcagcatccacctggagctgatcgccgacagacccctgcaggtgttccacgtggaggtgaaggtgaaggacatcaacgacaacccccccgtgttcagaggcagagagcagatcatcttcatccccgagagcagactgctgaacagcagattccccatcgagggcgccgccgacgccgacatcggcgccaacgccctgctgacctacaccctgagccccagcgactacttcagcctggacgtggaggccagcgacgagctgagcaagagcctgtggctggagctgagaaagtacctggacagagaggagacccccgagctgcacctgctgctgaccgccaccgacggcggcaagcccgagctgcagggcaccgtggagctgctgatcaccgtgctggacgtgaacgacaacgcccccctgttcgaccaggccgtgtacagagtgcacctgctggagaccaccgccaacggcaccctggtgaccaccctgaacgccagcgacgccgacgagggcgtgaacggcgaggtggtgttcagcttcgacagcggcatcagcagagacatccaggagaagttcaaggtggacagcagcagcggcgagatcagactgatcgacaagctggactacgaggagaccaagagctacgagatccaggtgaaggccgtggacaagggcagcccccccatgagcaaccactgcaaggtgctggtgaaggtgctggacgtgaacgacaacgcccccgagctggccgtgaccagcctgtacctgcccatcagagaggacgcccccctgagcaccgtgatcgccctgatcaccgtgagcgacagagacagcggcgccaacggccaggtgacctgcagcctgatgccccacgtgcccttcaagctggtgagcaccttcaagaactactacagcctggtgctggacagcgccctggacagagagagcctgagcgtgtacgagctggtggtgaccgccagagacggcggcagccccagcctgtgggccaccgccagagtgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcaactacgtgagcgtgcacgccgagagcggcaaggtgtacgccctgcagcccctggaccacgaggagctggagctgctgcagttccagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95695 - DNA, 2853 bp, Artificial Sequence
  Description of Artificial Sequence: Synthetic coding sequence
atggtgttcagcagaagaggcggcctgggcgccagagacctgctgctgtggctgctgctgctggccgcctgggaggtgggcagcggccagctgcactacagcatccccgaggaggccaagcacggcaccttcgtgggcagagtggcccaggacctgggcctggagctggccgagctggtgcccagactgttcagagtggccagcaagacccacagagacctgctggaggtgaacctgcagaacggcatcctgttcgtgaacagcagaatcgacagagaggagctgtgccagtggagcgccgagtgcagcatccacctggagctgatcgccgacagacccctgcaggtgttccacgtggaggtgaaggtgaaggacatcaacgacaacccccccgtgttcagaggcagagagcagatcatcttcatccccgagagcagactgctgaacagcagattccccatcgagggcgccgccgacgccgacatcggcgccaacgccctgctgacctacaccctgagccccagcgactacttcagcctggacgtggaggccagcgacgagctgagcaagagcctgtggctggagctgagaaagtacctggacagagaggagacccccgagctgcacctgctgctgaccgccaccgacggcggcaagcccgagctgcagggcaccgtggagctgctgatcaccgtgctggacgtgaacgacaacgcccccctgttcgaccaggccgtgtacagagtgcacctgctggagaccaccgccaacggcaccctggtgaccaccctgaacgccagcgacgccgacgagggcgtgaacggcgaggtggtgttcagcttcgacagcggcatcagcagagacatccaggagaagttcaaggtggacagcagcagcggcgagatcagactgatcgacaagctggactacgaggagaccaagagctacgagatccaggtgaaggccgtggacaagggcagcccccccatgagcaaccactgcaaggtgctggtgaaggtgctggacgtgaacgacaacgcccccgagctggccgtgaccagcctgtacctgcccatcagagaggacgcccccctgagcaccgtgatcgccctgatcaccgtgagcgacagagacagcggcgccaacggccaggtgacctgcagcctgatgccccacgtgcccttcaagctggtgagcaccttcaagaactactacagcctggtgctggacagcgccctggacagagagagcctgagcgtgtacgagctggtggtgaccgccagagacggcggcagccccagcctgtgggccaccgccagagtgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcaactacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggcccccagagtgggcggcaccatcggcgccgtgagcgagctggtgcccagactggtgggcgccggccacgtggtggccaaggtgagagccgtggacgccgacagcggctacaacgcctggctgagctacgagctgcagcccgccgccggcggcgccagaatccccttcagagtgggcctgtacaccggcgagatcagcaccaccagagtgctggacgaggccgacctgagcagatacagactgctggtgctggtgaaggaccacggcgagcccgccctgaccgccaccgccaccgtgctggtgagcctggtggagagcggccaggcccccaaggccagcagcagagccagcgtgggcgtggccggccccgaggccgccctggtggacgtgaacgtgtacctgatcatcgccatctgcgccgtgagcagcctgctggtgctgaccctgctgctgtacaccgccctgagatgcagcgtgccccccaccgagggcgcctacgtgcccggcaagcccaccctggtgtgcagcagcgccctgggcagctggagcaacagccagcagagaagacagagagtgtgcagcagcgagggcccccccaagaccgacctgatggccttcagccccggcctgagccccagcctgaacaccagcgagagaaacgagcagcccgaggccaacctggacctgagcggcaaccccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95696 - DNA, 2847 bp, Artificial Sequence
  Description of Artificial Sequence: Synthetic coding sequence
atggtgagcagatgcagctgcctgggcgtgcagtgcctgctgctgagcctgctgctgctggccgcctgggaggtgggcagcggccagctgcactacagcgtgtacgaggaggccagacacggcaccttcgtgggcagaatcgcccaggacctgggcctggagctggccgagctggtgcagagactgttcagagtggccagcaagagacacggcgacctgctggaggtgaacctgcagaacggcatcctgttcgtgaacagcagaatcgacagagaggagctgtgcggcagaagcgtggagtgcagcatccacctggaggtgatcgtggacagacccctgcaggtgttccacgtggacgtggaggtgaaggacatcaacgacaacccccccagattcagcgtgaccgagcagaagctgagcatccccgagagcagactgctggacagcagattccccctggagggcgccagcgacgccgacgtgggcgagaacgccctgctgacctacaagctgagccccaacgagtacttcgtgctggacatcatcaacaagaaggacaaggacaagttccccgtgctggtgctgagaaagctgctggacagagaggagaacccccagctgaagctgctgctgaccgccaccgacggcggcaagcccgagttcaccggcagcgtgagcctgctgatcctggtgctggacgccaacgacaacgcccccatcttcgacagacccgtgtacgaggtgaagatgtacgagaaccaggtgaaccagaccctggtgatcagactgaacgccagcgacagcgacgagggcatcaacaaggagatgatgtacagcttcagcagcctggtgccccccaccatcagaagaaagttctggatcaacgagagaaccggcgagatcaaggtgaacgacgccatcgacttcgaggacagcaacacctacgagatccacgtggacgtgaccgacaagggcaacccccccatggtgggccactgcaccgtgctggtggagctgctggacgagaacgacaacagccccgaggtgatcgtgaccagcctgagcctgcccgtgaaggaggacgcccaggtgggcaccgtgatcgccctgatcagcgtgagcgaccacgacagcggcgccaacggccaggtgacctgcagcctgaccccccacgtgcccttcaagctggtgagcacctacaagaactactacagcctggtgctggacagcgccctggacagagagagagtgagcgcctacgagctggtggtgaccgccagagacggcggcagcccccccctgtgggccaccgccagcgtgagcgtggaggtggccgacgtgaacgacaacgcccccgccttcgcccagagcgagtacaccgtgttcgtgaaggagaacaacccccccggctgccacatcttcaccgtgagcgcctgggacgccgacgcccaggagaacgccctggtgagctacagcctggtggagagaagactgggcgagagaagcctgagcagctacgtgagcgtgcacgccgagagcggcaaggtgtacgccctgcagcccctggaccacgaggagctggagctgctgcagttccaggtgagcgccagagacggcggcgtgccccccctgggcagcaacctgaccctgcaggtgttcgtgctggacgagaacgacaacgcccccgccctgctggccagccccgccggcagcgccggcggcgccgtgagcgagctggtgctgagaagcgtggtggccggccacgtggtggccaaggtgagagccgtggacgccgacagcggctacaacgcctggctgagctacgagctgcagagcgccgccgtgggcgccagaatccccttcagagtgggcctgtacaccggcgagatcagcaccaccagagccctggacgagaccgacagccccagacagagactgctggtgctggtgaaggaccacggcgagcccagcctgaccgccaccgccaccgtgctggtgagcctggtggagggcagccaggcccccaaggccagcagcagagccagcgtgggcgtggcccccgaggtggccctggtggacgtgaacgtgtacctgatcatcgccatctgcgccgtgagcagcctgctggtgctgaccctgctgctgtacaccgccctgagatgcagcgccgcccccaccgagggcgcctgcggccccgtgaagcccaccctggtgtgcagcagcgccgtgggcagctggagctacagccagcagagaagacagagagtgtgcagcggcgagggcctgcccaaggccgacctgatggccttcagccccagcctgcccccctgccccatggtggacgtggacggcgaggaccagagcatcggcggcgaccacagcagaaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95697 - DNA, 2058 bp, Artificial Sequence
  Description of Artificial Sequence: Synthetic coding sequence
atggtgagcagatgcagctgcctgggcgtgcagtgcctgctgctgagcctgctgctgctggccgcctgggaggtgggcagcggccagctgcactacagcgtgtacgaggaggccagacacggcaccttcgtgggcagaatcgcccaggacctgggcctggagctggccgagctggtgcagagactgttcagagtggccagcaagagacacggcgacctgctggaggtgaacctgcagaacggcatcctgttcgtgaacagcagaatcgacagagaggagctgtgcggcagaagcgtggagtgcagcatccacctggaggtgatcgtggacagacccctgcaggtgttccacgtggacgtggaggtgaaggacatcaacgacaacccccccagattcagcgtgaccgagcagaagctgagcatccccgagagcagactgctggacagcagattccccctggagggcgccagcgacgccgacgtgggcgagaacgccctgctgacctacaagctgagccccaacgagtacttcgtgctggacatcatcaacaagaaggacaaggacaagttccccgtgctggtgctgagaaagctgctggacagagaggagaacccccagctgaagctgctgctgaccgccaccgacggcggcaagcccgagttcaccggcagcgtgagcctgctgatcctggtgctggacgccaacgacaacgcccccatcttcgacagacccgtgtacgaggtgaagatgtacgagaaccaggtgaaccagaccctggtgatcagactgaacgccagcgacagcgacgagggcatcaacaaggagatgatgtacagcttcagcagcctggtgccccccaccatcagaagaaagttctggatcaacgagagaaccggcgagatcaaggtgaacgacgccatcgacttcgaggacagcaacacctacgagatccacgtggacgtgaccgacaagggcaacccccccatggtgggccactgcaccgtgctggtggagctgctggacgagaacgacaacagccccgaggtgatcgtgaccagcctgagcctgcccgtgaaggaggacgcccaggtgggcaccgtgatcgccctgatcagcgtgagcgaccacgacagcggcgccaacggccaggtgacctgcagcctgaccccccacgtgcccttcaagctggtgagcacctacaagaactactacagcctggtgctggacagcgccctggacagagagagagtgagcgcctacgagctggtggtgaccgccagagacggcggcagcccccccctgtgggccaccgccagcgtgagcgtggaggtggccgacgtgaacgacaacgcccccgccttcgcccagagcgagtacaccgtgttcgtgaaggagaacaacccccccggctgccacatcttcaccgtgagcgcctgggacgccgacgcccaggagaacgccctggtgagctacagcctggtggagagaagactgggcgagagaagcctgagcagctacgtgagcgtgcacgccgagagcggcaaggtgtacgccctgcagcccctggaccacgaggagctggagctgctgcagttccagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95698 - DNA, 2850 bp, Artificial Sequence
  Description of Artificial Sequence: Synthetic coding sequence
atgttcggcttccagagaagaggcctgggcacccccagactgcagctgtggctgctgctgctggagttctgggaggtgggcagcggccagctgcactacagcgtgagcgaggaggccaagcacggcaccttcgtgggcagaatcgcccaggacctgggcctggagctggccgagctggtgcagagactgttcagagtggccagcaagacccacggcgacctgctggaggtgaacctgcagaacggcatcctgttcgtgaacagcagaatcgacagagaggagctgtgcggccagagcgccgagtgcagcatccacctggaggtgatcgtggacagacccctgcaggtgttccacgtgaacgtggaggtgaaggacatcaacgacaacccccccgtgttcagcctgagagagcagaagctgctgatcgccgagagcaagcagagcgacagcagattccccctggagggcgccagcgacgccgacatcgaggagaacgccctgctgacctacagactgagcaagaacgagtacttcagcctggacagccccaccaacggcaagcagatcaagagactgagcctgatcctgaagaagagcctggacagagagaagacccccgagctgaacctgctgctgaccgccaccgacggcggcaagcccgagctgaccggcaccgtgagactgctggtgcaggtgctggacgtgaacgacaacgaccccgagttcgacaagagcgagtacaaggtgagcctgatggagaacgccgccaaggagaccctggtgctgaagctgaacgccaccgacagagacgagggcgtgaacggcgaggtgacctacagcctgatgagcatcaagcccaacggcagacacctgttcaccctggaccagaacaacggcgaggtgagagtgaacggcaccctggactacgaggagaacaagttctacaagatcgaggtgcaggccaccgacaagggcaccccccccatggccggccactgcaccgtgtgggtggagatcctggacaccaacgacaacagccccgaggtggccgtgaccagcctgagcctgcccgtgagagaggacgcccagcccagcaccgtgatcgccctgatcagcgtgagcgacagagacagcggcgtgaacggccaggtgacctgcagcctgaccccccacgtgcccttcaagctggtgagcaccttcaagaactactacagcctggtgctggacagcgccctggacagagagaacgtgtgggcctacgagctggtggtgaccgccagagacggcggcagccccagcctgtgggccaccgccagagtgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagactgggcgacagagccctgagcagctacgtgagcgtgcacgccgagagcggcaaggtgtacgccctgcagcccctggaccacgaggagctggagctgctgcagttccaggtgagcgccagagacgccggcgtgccccccctgagcagcaacgtgaccctgcaggtgttcgtgctggacgagaacgacaacgcccccgccctgctggccacccaggccggcagcgccggcggcgccgtgaacaagctggtgcccagaagcgtgggcgccggccacgtggtggccaaggtgagagccgtggacgccgacagcggctacaacgcctggctgagctacgagctgcagcccgccgccggcggcagcagaatccccttcagagtgggcctgtacaccggcgagatcagcaccaccagagccctggacgaggccgacagccccagacacagactgctggtgctggtgaaggaccacggcgagcccgccctgaccgccaccgccaccgtgctggtgagcctggtggagagcggccaggcccccaaggccagcagcagaaccctggccggcgccgccagccccgaggccgccctggtggacgtgaacgtgtacctgatcatcgccatctgcgtggtgagcagcctgctggtgctgaccctgctgctgtacaccgccctgtggtggagcgccacccccaccgagggcgcctgcgcccccggcaagcccaccctggtgtgcagcagagccgtgggcagctggagctacagccagcagagaagacagagagtgtgcagcgaggagggcccccccaagaccgacctgatggccttcagccccagcctgcccctgggcctgaacaaggaggaggagggcgagagacaggagcccggcagcaaccaccccggccagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95699 - DNA, 2826 bp, Artificial Sequence
  Description of Artificial Sequence: Synthetic coding sequence
atggtgatcatcggccccagaggccccggcagccagagactgctgctgagcctgctgctgctggccgcctgggaggtgggcagcggccagctgcactacagcgtgtacgaggaggccaagcacggcaccttcgtgggcagaatcgcccaggacctgggcctggagctggccgagctggtgcccagactgttcagagtggccagcaagagacacggcgacctgctggaggtgaacctgcagaacggcatcctgttcgtgaacagcagaatcgacagagagaagctgtgcggcagaagcgccgagtgcagcatccacctggaggtgatcgtggacagacccctgcaggtgttccacgtggacgtggaggtgaaggacatcaacgacaacccccccgtgttcagagagagagagcagaaggtgcccgtgagcgagagcgcccccctggacagccacttccccctggagggcgccagcgacgccgacatcggcgtgaacagcctgctgacctacgccctgagcctgaacgagaacttcgagctgaagatcaagaccaagaaggacaagagcatcctgcccgagctggtgctgagaaagctgctggacagagagcagacccccaagctgaacctgctgctgatggtgatcgacggcggcaagcccgagctgaccggcagcgtgcagatccagatcaccgtgctggacgtgaacgacaacggccccgccttcgacaagcccagctacaaggtggtgctgagcgagaacgtgcagaacgacaccagagtgatccagctgaacgccagcgaccccgacgagggcctgaacggcgagatcagctacggcatcaagatgatcctgcccgtgagcgagaagtgcatgttcagcatcaaccccgacaccggcgagatcagaatctacggcgagctggacttcgaggagaacaacgcctacgagatccaggtgaacgccatcgacaagggcatccccagcatggccggccacagcatggtgctggtggaggtgctggacgtgaacgacaacgtgcccgaggtgatggtgaccagcctgagcctgcccgtgcaggaggacgcccaggtgggcaccgtgatcgccctgatcagcgtgagcgacagagacagcggcgccaacggccaggtgatctgcagcctgaccccccacgtgcccttcaagctggtgagcacctacaagaactactacagcctggtgctggacagcgccctggacagagagagcgtgagcgcctacgagctggtggtgaccgccagagacggcggcagccccagcctgtgggccaccgccagagtgagcgtggaggtggccgacgtgaacgacaacgcccccgccttcgcccagcccgagtacaccgtgttcgtgaaggagaacaacccccccggctgccacatcttcaccgtgagcgcctgggacgccgacgcccagaagaacgccctggtgagctacagcctggtggagagaagagtgggcgagcacgccctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggccacccccgccggcagcgccggcggcgccgtgagcgagctggtgcccagaagcgtgggcgccggccacgtggtggccaaggtgagagccgtggacgccgacagcggctacaacgcctggctgagctacgagctgcagcccgccgccgtgggcgcccacatccccttccacgtgggcctgtacaccggcgagatcagcaccaccagaatcctggacgaggccgacgcccccagacacagactgctggtgctggtgaaggaccacggcgagcccgccctgaccagcaccgccaccgtgctggtgagcctggtggagaacggccaggcccccaagaccagcagcagagccagcgtgggcgccgtggaccccgaggccgccctggtggacatcaacgtgtacctgatcatcgccatctgcgccgtgagcagcctgctggtgctgaccctgctgctgtacaccgccctgagatgcagcgccccccccaccgtgagcagatgcgcccccggcaagcccaccctggtgtgcagcagcgccgtgggcagctggagctacagccagcagagaagacagagagtgtgcagcgccgagagcccccccaagaccgacctgatggccttcagccccagcctgcagctgagcagagaggactgcctgaacccccccagcgagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95700 - DNA, 2853 bp, Artificial Sequence
  Description of Artificial Sequence: Synthetic coding sequence
atgctgagcagctggcagggcggccccagacccagacagctgctgctgtggctgctgatcctggccgcctgggagaccggcagcggccagctgcactacagcgtgcccgaggaggccaagcacggcaccttcgtgggcagaatcgcccaggacctgggcctggagctggccgagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggaggtgaaggtgagagacatcaacgacaacccccccatcttccccgagagcaagaagagaatcatcatcgccgagagcagaccccccgagaccagattccccctggacggcgccagcgacgccgacatcggcgtgaacagcgccctgacctacagactggaccccaacgactacttcaccctggacgcccagaacagcctggagcagatgagcagcctgagcctggtgctgagaaagaccctggacagagaggagatccaggagcacagcctgctgctgaccgccagcgacggcggcaagcccgagctgaccggcaccgtgcagctgctgatcaccatcctggacgtgaacgacaacgcccccgagttctaccagagcgtgtacaaggtgaccgtgctggagaacgccttcaacggcaccctggtgatcaagctgaacgccaccgaccccgacgacggcaccaacggcgacatcgtgtacagcttcagaagacccgtgtggcccgccgtggtgtacgccttcaccatcaaccccaacaacggcgagatcagaaccaagggcaagctggacttcgaggagaagaagctgtacgagatcagcgtggaggccgtggacaagggcaacatccccatggccggccactgcaccctgctggtggaggtgctggacgtgaacgacaacgcccccgaggtgaccatcaccagcctgagcctgcccatcagagaggacacccagcccagcgccatcatcgccctgatcagcgtgagcgacagagacagcggcagcaacggccaggtgacctgcaccctgaccccccacgtgcccttcaagctggtgagcacctacaagaactactacagcctggtgctggacagcgccctggacagagagagcgtgagcgcctacgagctggtggtgaccgccagagacggcggcagccccagcctgtgggccaccgccagcgtgagcgtgggcgtggccgacgtgaacgacaacgcccccgccttcgcccagcccgagtacaccgtgttcgtgaaggagaacaacccccccggctgccacatcttcaccgtgagcgcccaggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgagcgccagagacagcggcgtgccccccctgggcagcaacgtgaccctgcaggtgttcgtgctggacgagaacgacaacgcccccgccctgctgacccccggcgccggcagcgccggcggcaccgtgagcgagctgatgcccagaagcgtgggcgccggccacgtggtggccaaggtgagagccgtggacgccgacagcggctacaacgcctggctgagctacgagctgcagctggccgccgtgggcgccagaatccccttcagagtgggcctgtacaccggcgagatcagcaccaccagacccctggacgaggtggacgccccccaccacagactgctggtgctggtgaaggaccacggcgagcccgccctgaccgccaccgccaccgtgctgctgagcctggtggagagcggccaggccccccaggccagcagcagagccagcgccggcgccgtgggccccgaggccgccctggtggacgtgaacgtgtacctgatcatcgccatctgcgccgtgagcagcctgctggtgctgaccctgctgctgtacaccgccctgagatgcagcgccccccccaccgagggcgcctgcgcccccggcaagcccaccctggtgtgcagcagcgccgccggcagctggagctacagccagcagagaagacccagagtgtgcagcggcgagggcccccacaagaccgacctgatggccttcagccccagcctgcccccctgcctgggcagcgccgagggcaccggccagagagaggaggacagcgagtgcctgaaggagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95701 - DNA, 2715 bp, Artificial Sequence
  Description of Artificial Sequence: Synthetic coding sequence
atgctgagcagctggcagggcggccccagacccagacagctgctgctgtggctgctgatcctggccgcctgggagaccggcagcggccagctgcactacagcgtgcccgaggaggccaagcacggcaccttcgtgggcagaatcgcccaggacctgggcctggagctggccgagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggaggtgaaggtgagagacatcaacgacaacccccccatcttccccgagagcaagaagagaatcatcatcgccgagagcagaccccccgagaccagattccccctggacggcgccagcgacgccgacatcggcgtgaacagcgccctgacctacagactggaccccaacgactacttcaccctggacgcccagaacagcctggagcagatgagcagcctgagcctggtgctgagaaagaccctggacagagaggagatccaggagcacagcctgctgctgaccgccagcgacggcggcaagcccgagctgaccggcaccgtgcagctgctgatcaccatcctggacgtgaacgacaacgcccccgagttctaccagagcgtgtacaaggtgaccgtgctggagaacgccttcaacggcaccctggtgatcaagctgaacgccaccgaccccgacgacggcaccaacggcgacatcgtgtacagcttcagaagacccgtgtggcccgccgtggtgtacgccttcaccatcaaccccaacaacggcgagatcagaaccaagggcaagctggacttcgaggagaagaagctgtacgagatcagcgtggaggccgtggacaagggcaacatccccatggccggccactgcaccctgctggtggaggtgctggacgtgaacgacaacgcccccgaggtgaccatcaccagcctgagcctgcccatcagagaggacacccagcccagcgccatcatcgccctgatcagcgtgagcgacagagacagcggcagcaacggccaggtgacctgcaccctgaccccccacgtgcccttcaagctggtgagcacctacaagaactactacagcctggtgctggacagcgccctggacagagagagcgtgagcgcctacgagctggtggtgaccgccagagacggcggcagccccagcctgtgggccaccgccagcgtgagcgtgggcgtggccgacgtgaacgacaacgcccccgccttcgcccagcccgagtacaccgtgttcgtgaaggagaacaacccccccggctgccacatcttcaccgtgagcgcccaggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgagcgccagagacagcggcgtgccccccctgggcagcaacgtgaccctgcaggtgttcgtgctggacgagaacgacaacgcccccgccctgctgacccccggcgccggcagcgccggcggcaccgtgagcgagctgatgcccagaagcgtgggcgccggccacgtggtggccaaggtgagagccgtggacgccgacagcggctacaacgcctggctgagctacgagctgcagctggccgccgtgggcgccagaatccccttcagagtgggcctgtacaccggcgagatcagcaccaccagacccctggacgaggtggacgccccccaccacagactgctggtgctggtgaaggaccacggcgagcccgccctgaccgccaccgccaccgtgctgctgagcctggtggagagcggccaggccccccaggccagcagcagagccagcgccggcgccgtgggccccgaggccgccctggtggacgtgaacgtgtacctgatcatcgccatctgcgccgtgagcagcctgctggtgctgaccctgctgctgtacaccgccctgagatgcagcgccccccccaccgagggcgcctgcgcccccggcaagcccaccctggtgtgcagcagcgccgccggcagctggagctacagccagcagagaagacccagagtgtgcagcggcgagggcccccacaagaccgacctgatggccttcagccccagcctgcccccctgcctgggcagcgccgagggcaccggccagagagaggaggacagcgagtgcctgaaggagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccgagcccaagaagcagacccaggtgagcttcctgctgagaagaaagggcgaggccagccagcccagacagtag

SEQ ID NO: 95702 - DNA, 2475 bp, Artificial Sequence
  Description of Artificial Sequence: Synthetic coding sequence
atggccagcagcatcagaagaggcagaggcgcctggaccagactgctgagcctgctgctgctggccgcctgggaggtgggcagcggccagctgagatacagcgtgcccgaggaggccaagcacggcaccttcgtgggcagaatcgcccaggacctgggcctggagctggaggagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacgtggaggtgatcgtggacagacccctgcaggtgttccacgtggaggtggaggtgaaggacatcaacgacaacccccccatcttccccatgaccgtgaagaccatcagattccccgagagcagactgctggacagcagattccccctggagggcgccagcgacgccgacatcggcgtgaacgccctgctgagctacaagctgagcagcagcgagttcttcttcctggacatccaggccaacgacgagctgagcgagagcctgagcctggtgctgggcaagagcctggacagagaggagaccgccgaggtgaacctgctgctggtggccaccgacggcggcaagcccgagctgaccggcaccgtgcagatcctgatcaaggtgctggacgtgaacgacaacgagcccaccttcgcccagagcgtgtacaaggtgaagctgctggagaacaccgccaacggcaccctggtggtgaagctgaacgccagcgacgccgacgagggccccaacagcgagatcgtgtacagcctgggcagcgacgtgagcagcaccatccagaccaagttcaccatcgaccccatcagcggcgagatcagaaccaagggcaagctggactacgaggaggccaagagctacgagatccaggtgaccgccaccgacaagggcacccccagcatgagcggccactgcaagatcagcctgaagctggtggacatcaacgacaacacccccgaggtgagcatcaccagcctgagcctgcccatcagcgagaacgccagcctgggcaccgtgatcgccctgatcaccgtgagcgacagagacagcggcaccaacggccacgtgacctgcagcctgaccccccacgtgcccttcaagctggtgagcaccttcaagaactactacagcctggtgctggacagcgccctggacagagagagcgtgagcgcctacgagctggtggtgaccgccagagacggcggcagccccagcctgtgggccaccaccagcgtgagcatcgaggtggccgacgtgaacgacaacgcccccgccttcgcccagcccgagtacaccgtgttcgtgaaggagaacaacccccccggctgccacatcttcaccgtgagcgcctgggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggaggtggagctgctgcagttccaggtgagcgccagagacgccggcgtgccccccctgggcagcaacgtgaccctgcaggtgttcgtgctggacgagaacgacaacgcccccgccctgctggcccccagagccggcaccgccgccggcgccgtgagcgagctggtgccctggagcgtgggcgccggccacgtggtggccaaggtgagagccgtggacgccgacagcggctacaacgcctggctgagctacgagctgcagctgggcaccggcagcgccagaatccccttcagagtgggcctgtacaccggcgagatcagcaccaccagagccctggacgaggccgacagccccagacacagactgctggtgctggtgaaggaccacggcgagcccgccctgaccgccaccgccaccgtgctggtgagcctggtggagagcggccaggcccccaaggccagcagcagagcctgggtgggcgccgccggcagcgaggccaccctggtggacgtgaacgtgtacctgatcatcgccatctgcgccgtgagcagcctgctggtgctgaccgtgctgctgtacaccgccctgagatgcagcgtgccccccaccgagggcgccagagcccccggcaagcccaccctggtgtgcagcagcgccgtgggcagctggagctacagccagcagagaagacagagagtgtgcagcggcgaggacccccccaagaccgacctgatggccttcagccccagcctgagccagggccccgacagcgccgaggagaagcagctgagcgagagcgagtacgtgggcaaggtgagcctgctgctgttcctggccaacagcaagatcgtgctgttcaagaagttctacatgatcagcaccagctacctggacagctag

SEQ ID NO: 95703 - DNA, 2847 bp, Artificial Sequence
  Description of Artificial Sequence: Synthetic coding sequence
atggccagcagcatcagaagaggcagaggcgcctggaccagactgctgagcctgctgctgctggccgcctgggaggtgggcagcggccagctgagatacagcgtgcccgaggaggccaagcacggcaccttcgtgggcagaatcgcccaggacctgggcctggagctggaggagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacgtggaggtgatcgtggacagacccctgcaggtgttccacgtggaggtggaggtgaaggacatcaacgacaacccccccatcttccccatgaccgtgaagaccatcagattccccgagagcagactgctggacagcagattccccctggagggcgccagcgacgccgacatcggcgtgaacgccctgctgagctacaagctgagcagcagcgagttcttcttcctggacatccaggccaacgacgagctgagcgagagcctgagcctggtgctgggcaagagcctggacagagaggagaccgccgaggtgaacctgctgctggtggccaccgacggcggcaagcccgagctgaccggcaccgtgcagatcctgatcaaggtgctggacgtgaacgacaacgagcccaccttcgcccagagcgtgtacaaggtgaagctgctggagaacaccgccaacggcaccctggtggtgaagctgaacgccagcgacgccgacgagggccccaacagcgagatcgtgtacagcctgggcagcgacgtgagcagcaccatccagaccaagttcaccatcgaccccatcagcggcgagatcagaaccaagggcaagctggactacgaggaggccaagagctacgagatccaggtgaccgccaccgacaagggcacccccagcatgagcggccactgcaagatcagcctgaagctggtggacatcaacgacaacacccccgaggtgagcatcaccagcctgagcctgcccatcagcgagaacgccagcctgggcaccgtgatcgccctgatcaccgtgagcgacagagacagcggcaccaacggccacgtgacctgcagcctgaccccccacgtgcccttcaagctggtgagcaccttcaagaactactacagcctggtgctggacagcgccctggacagagagagcgtgagcgcctacgagctggtggtgaccgccagagacggcggcagccccagcctgtgggccaccaccagcgtgagcatcgaggtggccgacgtgaacgacaacgcccccgccttcgcccagcccgagtacaccgtgttcgtgaaggagaacaacccccccggctgccacatcttcaccgtgagcgcctgggacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggaggtggagctgctgcagttccaggtgagcgccagagacgccggcgtgccccccctgggcagcaacgtgaccctgcaggtgttcgtgctggacgagaacgacaacgcccccgccctgctggcccccagagccggcaccgccgccggcgccgtgagcgagctggtgccctggagcgtgggcgccggccacgtggtggccaaggtgagagccgtggacgccgacagcggctacaacgcctggctgagctacgagctgcagctgggcaccggcagcgccagaatccccttcagagtgggcctgtacaccggcgagatcagcaccaccagagccctggacgaggccgacagccccagacacagactgctggtgctggtgaaggaccacggcgagcccgccctgaccgccaccgccaccgtgctggtgagcctggtggagagcggccaggcccccaaggccagcagcagagcctgggtgggcgccgccggcagcgaggccaccctggtggacgtgaacgtgtacctgatcatcgccatctgcgccgtgagcagcctgctggtgctgaccgtgctgctgtacaccgccctgagatgcagcgtgccccccaccgagggcgccagagcccccggcaagcccaccctggtgtgcagcagcgccgtgggcagctggagctacagccagcagagaagacagagagtgtgcagcggcgaggacccccccaagaccgacctgatggccttcagccccagcctgagccagggccccgacagcgccgaggagaagcagctgagcgagagcgagtacgtgggcaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95704 - DNA, 2853 bp, Artificial Sequence
  Description of Artificial Sequence: Synthetic coding sequence
atgctgttcagctggagagaggaccccggcgcccagtgcctgctgctgagcctgctgctgctggccgccagcgaggtgggcagcggccagctgcactacagcgtgagcgaggaggccaagcacggcaccttcgtgggcagaatcgcccaggacctgggcctggagctggccgagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggaggtggaggtgaaggacatcaacgacaacgcccccgtgttccccatggccgtgaagaacctgttcatcagcgagagcagacagcccggcagcagattcagcctggagggcgccagcgacgccgacatcggcaccaacagcctgctgacctacagcctggacagcaccgagtacttcaccctggacgtgaagagaaacgacgaggagatcaagagcctgggcctggtgctgaagaagaacctgaacagagaggacacccccaagcactacctgctgatcaccgccatcgacggcggcaagcccgagctgaccggcaccacccagctgaagatcaccgtgctggacgtgaacgacaacgcccccgccttcgagagaaccatctacaaggtgagactgctggagaacgcccccaacggcaccctggtggtgaccgtgaacgccaccgacctggacgagggcgtgaacaaggacatcgcctacagcttcaacaccgacatgagcgccgacatcctgagcaagttccacctggaccccgtgaacggccagatcagcgtgaagggcaacatcgacttcgaggagagcaagagctacgagatccaggtggaggccaccgacaagggcaacccccccatgagcgaccactgcaccgtgctgctggagatcgtggacatcaacgacaacgtgcccgagctggtgatccagagcctgagcctgcccgtgctggaggacagccccctgagcaccgtgatcgccctgatcagcgtgagcgacagagacagcggcgtgaacggccaggtgacctgcagcctgaccccccacgtgcccttcaagctggtgagcaccttcaagaactactacagcctggtgctggacagccccctggacagagagagcgtgagcgcctacgagctggtggtgaccgccagagacggcggcagccccagcctgtgggccaccgccagcgtgagcgtggaggtggccgacgtgaacgacaacgcccccgccttcagccagagcgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctgatgcccagagtgggcggcatcggcggcgccgtgagcgagctggtgcccagaagcgtgggcgccggccacgtggtggccaaggtgagagccgtggacgccgacagcggctacaacgcctggctgagctacgagctgcagcccggcaccggcggcgccagaatccccttcagagtgggcctgtacaccggcgagatcagcaccaccagagccctggacgaggtggacgcccccagacacagactgctggtgctggtgaaggaccacggcgagcccagcctgaccgccaccgccaccgtgctggtgagcctggtggagagcggccaggcccccaaggccagcagccaggccagcgccggcgccaccggccccgaggccgccctggtggacgtgaacgtgtacctgatcgtggccatctgcgccgtgagcagcctgctggtgctgaccctgctgctgtacaccgccctgagatgcagcgccccccccaccgagggcgactgcggccccggcaagcccaccctggtgtgcagcagcgccgtgggcagctggagctacagccagcagagacagcagagagtgtgcagcggcgagggcctgcccaagaccgacctgatggccttcagccccagcctgcccccctgccccatcagcagagacagagaggagaagcaggacgtggacgtggacctgagcgccaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95705 - DNA, 2475 bp, Artificial Sequence
  Description of Artificial Sequence: Synthetic coding sequence
atgctgttcagctggagagaggaccccggcgcccagtgcctgctgctgagcctgctgctgctggccgccagcgaggtgggcagcggccagctgcactacagcgtgagcgaggaggccaagcacggcaccttcgtgggcagaatcgcccaggacctgggcctggagctggccgagctggtgcccagactgttcagagtggccagcaagagacacggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggaggtggaggtgaaggacatcaacgacaacgcccccgtgttccccatggccgtgaagaacctgttcatcagcgagagcagacagcccggcagcagattcagcctggagggcgccagcgacgccgacatcggcaccaacagcctgctgacctacagcctggacagcaccgagtacttcaccctggacgtgaagagaaacgacgaggagatcaagagcctgggcctggtgctgaagaagaacctgaacagagaggacacccccaagcactacctgctgatcaccgccatcgacggcggcaagcccgagctgaccggcaccacccagctgaagatcaccgtgctggacgtgaacgacaacgcccccgccttcgagagaaccatctacaaggtgagactgctggagaacgcccccaacggcaccctggtggtgaccgtgaacgccaccgacctggacgagggcgtgaacaaggacatcgcctacagcttcaacaccgacatgagcgccgacatcctgagcaagttccacctggaccccgtgaacggccagatcagcgtgaagggcaacatcgacttcgaggagagcaagagctacgagatccaggtggaggccaccgacaagggcaacccccccatgagcgaccactgcaccgtgctgctggagatcgtggacatcaacgacaacgtgcccgagctggtgatccagagcctgagcctgcccgtgctggaggacagccccctgagcaccgtgatcgccctgatcagcgtgagcgacagagacagcggcgtgaacggccaggtgacctgcagcctgaccccccacgtgcccttcaagctggtgagcaccttcaagaactactacagcctggtgctggacagccccctggacagagagagcgtgagcgcctacgagctggtggtgaccgccagagacggcggcagccccagcctgtgggccaccgccagcgtgagcgtggaggtggccgacgtgaacgacaacgcccccgccttcagccagagcgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctgatgcccagagtgggcggcatcggcggcgccgtgagcgagctggtgcccagaagcgtgggcgccggccacgtggtggccaaggtgagagccgtggacgccgacagcggctacaacgcctggctgagctacgagctgcagcccggcaccggcggcgccagaatccccttcagagtgggcctgtacaccggcgagatcagcaccaccagagccctggacgaggtggacgcccccagacacagactgctggtgctggtgaaggaccacggcgagcccagcctgaccgccaccgccaccgtgctggtgagcctggtggagagcggccaggcccccaaggccagcagccaggccagcgccggcgccaccggccccgaggccgccctggtggacgtgaacgtgtacctgatcgtggccatctgcgccgtgagcagcctgctggtgctgaccctgctgctgtacaccgccctgagatgcagcgccccccccaccgagggcgactgcggccccggcaagcccaccctggtgtgcagcagcgccgtgggcagctggagctacagccagcagagacagcagagagtgtgcagcggcgagggcctgcccaagaccgacctgatggccttcagccccagcctgcccccctgccccatcagcagagacagagaggagaagcaggacgtggacgtggacctgagcgccaaggtgagcaacttctacctgttcttccccaagtgcctgtgcttcagcttcctgaacgtgagcacccccctggagatccactag

SEQ ID NO: 95706 - DNA, 2451 bp, Artificial Sequence
  Description of Artificial Sequence: Synthetic coding sequence
atggtgtacagcagaagaggcagcctgggcagcagactgctgctgctgtggctgctgctggcctactggaaggccggcagcggccagctgcactacagcatccccgaggaggccaagcacggcaccttcgtgggcagaatcgcccaggacctgggcctggagctggccgagctggtgcccagactgttcagagtggccagcaagggcagaggcgacctgctggaggtgaacctgcagaacggcatcctgttcgtgaacagcagaatcgacagagaggagctgtgcagaagaagagccgagtgcagcatccacctggaggtgatcgtggacagacccctgcaggtgttccacgtggaggtggccgtgaaggacatcaacgacaacccccccagattcagcagacaggagcagagactgttcatcctggagagcagaatgcccgacagcagattccccctggagggcgccagcgacctggacatcggcgccaacgcccagctgagatacagactgaaccccaacgagtacttcgacctggacgtgaagaccaacgaggaggagaccaacttcctggagctggtgctgagaaagagcctggacagagaggagacccaggagcacagactgctggtgatcgccaccgacggcggcaagcccgagctgaccggcaccgtgcagctgctgatcaacgtgctggacgccaacgacaacgcccccgagttcgacaagagcatctacaacgtgagactgctggagaacgcccccagcggcaccctggtgatcaagctgaacgccagcgacgccgacgagggcatcaacaaggagatcgtgtacttcttcagcaacctggtgctggacgacgtgaagagcaagttcatcatcaacagcaacaccggcgagatcaaggtgaacggcgagctggactacgaggactacaacagctacgagatcaacatcgacgccatggacaagagcaccttccccctgagcggccactgcaaggtggtggtgaagctgctggacgtgaacgacaacacccccgagatggccatcaccaccctgttcctgcccgtgaaggaggacgcccccctgagcaccgtgatcgccctgatcagcgtgagcgacagagacagcggcgccaacggccaggtgacctgcagcctgatgccccacgtgcccttcaagctggtgagcaccttcaagaactactacagcctggtgctggacagcgccctggacagagagagcgtgagcgtgtacgagctggtggtgaccgccagagacggcggcagccccagcctgtgggccaccgccagcgtgagcgtggaggtggccgacgtgaacgacaacgcccccgccttcgcccagccccagtacaccgtgttcgtgaaggagaacaacccccccggctgccacatcttcaccgtgagcgccagagacgccgacgcccaggagaacgccctggtgagctacagcctggtggagagaagagtgggcgagagacccctgagcagctacgtgagcgtgcacgccgagagcggcaaggtgtacgccctgcagcccctggaccacgaggaggtggagctgctgcagttccaggtgagcgccagagacgccggcgtgccccccctgggcagcaacgtgaccctgcaggtgttcgtgctggacgagaacgacaacgcccccgccctgctggtgcccagagtgggcggcaccggcggcgccgtgagcgagctggtgcccagaagcgtgggcgccggccacgtggtggccaaggtgagagccgtggaccccgacagcggctacaacgcctggctgagctacgagctgcagcccgcccccggcagcgccagaatccccttcagagtgggcctgtacaccggcgagatcagcaccaccagaagcctggacgagaccgaggcccccagacacagactgctggtgctggtgaaggaccacggcgagccccccctgaccgccaccgccaccgtgctggtgagcctggtggagagcggccaggcccccaaggccagcagcagagccagcgccggcgccgtgggccccgaggccgccctggtggacgtgaacgtgtacctgatcatcgccatctgcgccgtgagcagcctgctggtgctgaccctgctgctgtacaccgccctgagatgcagcgcccagcccaccgaggccgtgtgcaccagaggcaagcccaccctgctgtgcagcagcgccgtgggcagctggagctacagccagcagagaagacagagagtgtgcagcggcgaggccccccccaagaccgacctgatggccttcagccccagcctgccccagggccccaccagcaccgacaacgtgagcttcctgatcctgaccagcatcttccccagccagttcagcaacatcaagtgccacatccaccccctgttcctgtacctgaagatcatgagctag

SEQ ID NO: 95707 - DNA, 2673 bp, Artificial Sequence
  Description of Artificial Sequence: Synthetic coding sequence
atggtgtacagcagaagaggcagcctgggcagcagactgctgctgctgtggctgctgctggcctactggaaggccggcagcggccagctgcactacagcatccccgaggaggccaagcacggcaccttcgtgggcagaatcgcccaggacctgggcctggagctggccgagctggtgcccagactgttcagagtggccagcaagggcagaggcgacctgctggaggtgaacctgcagaacggcatcctgttcgtgaacagcagaatcgacagagaggagctgtgcagaagaagagccgagtgcagcatccacctggaggtgatcgtggacagacccctgcaggtgttccacgtggaggtggccgtgaaggacatcaacgacaacccccccagattcagcagacaggagcagagactgttcatcctggagagcagaatgcccgacagcagattccccctggagggcgccagcgacctggacatcggcgccaacgcccagctgagatacagactgaaccccaacgagtacttcgacctggacgtgaagaccaacgaggaggagaccaacttcctggagctggtgctgagaaagagcctggacagagaggagacccaggagcacagactgctggtgatcgccaccgacggcggcaagcccgagctgaccggcaccgtgcagctgctgatcaacgtgctggacgccaacgacaacgcccccgagttcgacaagagcatctacaacgtgagactgctggagaacgcccccagcggcaccctggtgatcaagctgaacgccagcgacgccgacgagggcatcaacaaggagatcgtgtacttcttcagcaacctggtgctggacgacgtgaagagcaagttcatcatcaacagcaacaccggcgagatcaaggtgaacggcgagctggactacgaggactacaacagctacgagatcaacatcgacgccatggacaagagcaccttccccctgagcggccactgcaaggtggtggtgaagctgctggacgtgaacgacaacacccccgagatggccatcaccaccctgttcctgcccgtgaaggaggacgcccccctgagcaccgtgatcgccctgatcagcgtgagcgacagagacagcggcgccaacggccaggtgacctgcagcctgatgccccacgtgcccttcaagctggtgagcaccttcaagaactactacagcctggtgctggacagcgccctggacagagagagcgtgagcgtgtacgagctggtggtgaccgccagagacggcggcagccccagcctgtgggccaccgccagcgtgagcgtggaggtggccgacgtgaacgacaacgcccccgccttcgcccagccccagtacaccgtgttcgtgaaggagaacaacccccccggctgccacatcttcaccgtgagcgccagagacgccgacgcccaggagaacgccctggtgagctacagcctggtggagagaagagtgggcgagagacccctgagcagctacgtgagcgtgcacgccgagagcggcaaggtgtacgccctgcagcccctggaccacgaggaggtggagctgctgcagttccaggtgagcgccagagacgccggcgtgccccccctgggcagcaacgtgaccctgcaggtgttcgtgctggacgagaacgacaacgcccccgccctgctggtgcccagagtgggcggcaccggcggcgccgtgagcgagctggtgcccagaagcgtgggcgccggccacgtggtggccaaggtgagagccgtggaccccgacagcggctacaacgcctggctgagctacgagctgcagcccgcccccggcagcgccagaatccccttcagagtgggcctgtacaccggcgagatcagcaccaccagaagcctggacgagaccgaggcccccagacacagactgctggtgctggtgaaggaccacggcgagccccccctgaccgccaccgccaccgtgctggtgagcctggtggagagcggccaggcccccaaggccagcagcagagccagcgccggcgccgtgggccccgaggccgccctggtggacgtgaacgtgtacctgatcatcgccatctgcgccgtgagcagcctgctggtgctgaccctgctgctgtacaccgccctgagatgcagcgcccagcccaccgaggccgtgtgcaccagaggcaagcccaccctgctgtgcagcagcgccgtgggcagctggagctacagccagcagagaagacagagagtgtgcagcggcgaggccccccccaagaccgacctgatggccttcagccccagcctgccccagggccccaccagcaccgacaaccccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccgagcccaagaagcagacccaggtgagcttcctgctgagaagaaagggcgaggccagccagcccagacagtag

SEQ ID NO: 95708 - DNA, 2811 bp, Artificial Sequence
  Description of Artificial Sequence: Synthetic coding sequence
atggtgtacagcagaagaggcagcctgggcagcagactgctgctgctgtggctgctgctggcctactggaaggccggcagcggccagctgcactacagcatccccgaggaggccaagcacggcaccttcgtgggcagaatcgcccaggacctgggcctggagctggccgagctggtgcccagactgttcagagtggccagcaagggcagaggcgacctgctggaggtgaacctgcagaacggcatcctgttcgtgaacagcagaatcgacagagaggagctgtgcagaagaagagccgagtgcagcatccacctggaggtgatcgtggacagacccctgcaggtgttccacgtggaggtggccgtgaaggacatcaacgacaacccccccagattcagcagacaggagcagagactgttcatcctggagagcagaatgcccgacagcagattccccctggagggcgccagcgacctggacatcggcgccaacgcccagctgagatacagactgaaccccaacgagtacttcgacctggacgtgaagaccaacgaggaggagaccaacttcctggagctggtgctgagaaagagcctggacagagaggagacccaggagcacagactgctggtgatcgccaccgacggcggcaagcccgagctgaccggcaccgtgcagctgctgatcaacgtgctggacgccaacgacaacgcccccgagttcgacaagagcatctacaacgtgagactgctggagaacgcccccagcggcaccctggtgatcaagctgaacgccagcgacgccgacgagggcatcaacaaggagatcgtgtacttcttcagcaacctggtgctggacgacgtgaagagcaagttcatcatcaacagcaacaccggcgagatcaaggtgaacggcgagctggactacgaggactacaacagctacgagatcaacatcgacgccatggacaagagcaccttccccctgagcggccactgcaaggtggtggtgaagctgctggacgtgaacgacaacacccccgagatggccatcaccaccctgttcctgcccgtgaaggaggacgcccccctgagcaccgtgatcgccctgatcagcgtgagcgacagagacagcggcgccaacggccaggtgacctgcagcctgatgccccacgtgcccttcaagctggtgagcaccttcaagaactactacagcctggtgctggacagcgccctggacagagagagcgtgagcgtgtacgagctggtggtgaccgccagagacggcggcagccccagcctgtgggccaccgccagcgtgagcgtggaggtggccgacgtgaacgacaacgcccccgccttcgcccagccccagtacaccgtgttcgtgaaggagaacaacccccccggctgccacatcttcaccgtgagcgccagagacgccgacgcccaggagaacgccctggtgagctacagcctggtggagagaagagtgggcgagagacccctgagcagctacgtgagcgtgcacgccgagagcggcaaggtgtacgccctgcagcccctggaccacgaggaggtggagctgctgcagttccaggtgagcgccagagacgccggcgtgccccccctgggcagcaacgtgaccctgcaggtgttcgtgctggacgagaacgacaacgcccccgccctgctggtgcccagagtgggcggcaccggcggcgccgtgagcgagctggtgcccagaagcgtgggcgccggccacgtggtggccaaggtgagagccgtggaccccgacagcggctacaacgcctggctgagctacgagctgcagcccgcccccggcagcgccagaatccccttcagagtgggcctgtacaccggcgagatcagcaccaccagaagcctggacgagaccgaggcccccagacacagactgctggtgctggtgaaggaccacggcgagccccccctgaccgccaccgccaccgtgctggtgagcctggtggagagcggccaggcccccaaggccagcagcagagccagcgccggcgccgtgggccccgaggccgccctggtggacgtgaacgtgtacctgatcatcgccatctgcgccgtgagcagcctgctggtgctgaccctgctgctgtacaccgccctgagatgcagcgcccagcccaccgaggccgtgtgcaccagaggcaagcccaccctgctgtgcagcagcgccgtgggcagctggagctacagccagcagagaagacagagagtgtgcagcggcgaggccccccccaagaccgacctgatggccttcagccccagcctgccccagggccccaccagcaccgacaaccccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95709 - DNA, 2061 bp, Artificial Sequence
  Description of Artificial Sequence: Synthetic coding sequence
atggtgttcacccccgaggacagactgggcaagcagtgcctgctgctgcccctgctgctgctggccgcctggaaggtgggcagcggccagctgcactacagcgtgcccgaggaggccaagcacggcaccttcgtgggcagaatcgcccaggacctgggcctggagctggccgagctggtgcccagactgttcagaatggccagcaaggacagagaggacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgagagacatcaacgacaacccccccctgttccccgtggaggagcagagagtgctgatctacgagagcagactgcccgacagcgtgttccccctggagggcgccagcgacgccgacgtgggcagcaacagcatcctgacctacaagctgagcagcagcgagtacttcggcctggacgtgaagatcaacagcgacgacaacaagcagatcggcctgctgctgaagaagagcctggacagagaggaggcccccgcccacaacctgttcctgaccgccaccgacggcggcaagcccgagctgaccggcaccgtgcagctgctggtgaccgtgctggacgtgaacgacaacgcccccaccttcgagcagagcgagtacgaggtgagaatcttcgagaacgccgacaacggcaccaccgtgatcagactgaacgccagcgacagagacgagggcgccaacggcgccatcagctacagcttcaacagcctggtggccgccatggtgatcgaccacttcagcatcgacagaaacaccggcgagatcgtgatcagaggcaacctggacttcgagcaggagaacctgtacaagatcctgatcgacgccaccgacaagggccacccccccatggccggccactgcaccgtgctggtgagaatcctggacaagaacgacaacgtgcccgagatcgccctgaccagcctgagcctgcccgtgagagaggacgcccagttcggcaccgtgatcgccctgatcagcgtgaacgacctggacagcggcgccaacggccaggtgaactgcagcctgaccccccacgtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcctgagcgtggaggtggccgacatgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcagctacatcagcgtgcacgccgagagcggcaaggtgtacgccctgcagcccctggaccacgaggagctggagctgctgcagttccagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95710 - DNA, 2853 bp, Artificial Sequence
  Description of Artificial Sequence: Synthetic coding sequence
atggtgttcacccccgaggacagactgggcaagcagtgcctgctgctgcccctgctgctgctggccgcctggaaggtgggcagcggccagctgcactacagcgtgcccgaggaggccaagcacggcaccttcgtgggcagaatcgcccaggacctgggcctggagctggccgagctggtgcccagactgttcagaatggccagcaaggacagagaggacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgagagacatcaacgacaacccccccctgttccccgtggaggagcagagagtgctgatctacgagagcagactgcccgacagcgtgttccccctggagggcgccagcgacgccgacgtgggcagcaacagcatcctgacctacaagctgagcagcagcgagtacttcggcctggacgtgaagatcaacagcgacgacaacaagcagatcggcctgctgctgaagaagagcctggacagagaggaggcccccgcccacaacctgttcctgaccgccaccgacggcggcaagcccgagctgaccggcaccgtgcagctgctggtgaccgtgctggacgtgaacgacaacgcccccaccttcgagcagagcgagtacgaggtgagaatcttcgagaacgccgacaacggcaccaccgtgatcagactgaacgccagcgacagagacgagggcgccaacggcgccatcagctacagcttcaacagcctggtggccgccatggtgatcgaccacttcagcatcgacagaaacaccggcgagatcgtgatcagaggcaacctggacttcgagcaggagaacctgtacaagatcctgatcgacgccaccgacaagggccacccccccatggccggccactgcaccgtgctggtgagaatcctggacaagaacgacaacgtgcccgagatcgccctgaccagcctgagcctgcccgtgagagaggacgcccagttcggcaccgtgatcgccctgatcagcgtgaacgacctggacagcggcgccaacggccaggtgaactgcagcctgaccccccacgtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcctgagcgtggaggtggccgacatgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagagccctgagcagctacatcagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggcccccagagtgggcggcaccggcggcgccgtgagcgagctggtgcccagaagcctgggcgccggccaggtggtggccaaggtgagagccgtggacgccgacagcggctacaacgcctggctgagctacgagctgcagccccccgccagcagcgccagattccccttcagagtgggcctgtacaccggcgagatcagcaccaccagagtgctggacgaggccgacagccccagacacagactgctggtgctggtgaaggaccacggcgagcccgccctgaccgccaccgccaccgtgctggtgagcctggtggagagcggccaggcccccaaggccagcagcagagccagcgtgggcgccgccggccccgaggccgccctggtggacgtgaacgtgtacctgatcatcgccatctgcgccgtgagcagcctgctggtgctgaccctgctgctgtacaccgccctgagatgcagcgccccccccaccgagggcgcctgcaccgccgacaagcccaccctggtgtgcagcagcgccgtgggcagctggagctacagccagcagagaagacagagagtgtgcagcggcgagggcccccccaagatggacctgatggccttcagccccagcctgagcccctgccccatcatgatgggcaaggccgagaaccaggacctgaacgaggaccacgacgccaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95711 - DNA, 2370 bp, Artificial Sequence
  Description of Artificial Sequence: Synthetic coding sequence
atggtgtgccccaacggctacgaccccggcggcagacacctgctgctgttcatcatcatcctggccgcctgggaggccggcagaggccagctgcactacagcgtgcccgaggaggccaagcacggcaacttcgtgggcagaatcgcccaggacctgggcctggagctggccgagctggtgcccagactgttcagagccgtgtgcaagttcagaggcgacctgctggaggtgaacctgcagaacggcatcctgttcgtgaacagcagaatcgacagagaggagctgtgcggcagaagcgccgagtgcagcatccacctggaggtgatcgtggagagacccctgcaggtgttccacgtggacgtggaggtgaaggacatcaacgacaacccccccgtgttccccgccacccagagaaacctgttcatcgccgagagcagacccctggacagcagattccccctggagggcgccagcgacgccgacatcggcgagaacgccctgctgacctacagactgagccccaacgagtacttcttcctggacgtgcccaccagcaaccagcaggtgaagcccctgggcctggtgctgagaaagctgctggacagagaggagacccccgagctgcacctgctgctgaccgccaccgacggcggcaagcccgagctgaccggcaccgtgcagctgctgatcaccgtgctggacaacaacgacaacgcccccgtgttcgacagaaccctgtacaccgtgaagctgcccgagaacgtgagcatcggcaccctggtgatccaccccaacgccagcgacctggacgagggcctgaacggcgacatcatctacagcttcagcagcgacgtgagccccgacatcaagagcaagttccacatggaccccctgagcggcgccatcaccgtgatcggccacatggacttcgaggagagcagagcccacaagatccccgtggaggccgtggacaagggcttcccccccctggccggccactgcaccgtgctggtggaggtggtggacgtgaacgacaacgccccccagctgaccctgaccagcctgagcctgcccatccccgaggacgcccagcccggcaccgtgatcaccctgatcagcgtgttcgacagagacttcggcgtgaacggccaggtgacctgcagcctgacccccagagtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcgtgagcgtggaggtggccgacgtgaacgacaacgcccccgccttcgcccagcccgagtacaccgtgttcgtgaaggagaacaacccccccggctgccacatcttcaccgtgagcgccggcgacgccgacgcccagaagaacgccctggtgagctacagcctggtggagctgagagtgggcgagagagccctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggcccccagagtgggcggcaccggcggcgccgtgagagagctggtgcccagaagcgtgggcgccggccacgtggtggccaaggtgagagccgtggacgccgacagcggctacaacgcctggctgagctacgagctgcagcccgtggccgccggcgccagcatccccttcagagtgggcctgtacaccggcgagatcagcaccaccagagccctggacgagaccgacgcccccagacacagactgctggtgctggtgaaggaccacggcgagcccagcctgaccgccaccgccaccgtgctggtgagcctggtggagagcggccaggcccccaaggccagcagcagagccagcctgggcatcgccggccccgagaccgagctggtggacgtgaacgtgtacctgatcatcgccatctgcgccgtgagcagcctgctggtgctgaccctgctgctgtacaccgccctgagatgcagcgcccccagcagcgagggcgcctgcagcctggtgaagcccaccctggtgtgcagcagcgccgtgggcagctggagcttcagccagcagagaagacagagagtgtgcagcggcgagggcccccccaagaccgacctgatggccttcagccccagcctgccccagggccccagcagcaccgacaacgtgagccacaagtag

SEQ ID NO: 95712 - DNA, 2814 bp, Artificial Sequence
  Description of Artificial Sequence: Synthetic coding sequence
atggtgtgccccaacggctacgaccccggcggcagacacctgctgctgttcatcatcatcctggccgcctgggaggccggcagaggccagctgcactacagcgtgcccgaggaggccaagcacggcaacttcgtgggcagaatcgcccaggacctgggcctggagctggccgagctggtgcccagactgttcagagccgtgtgcaagttcagaggcgacctgctggaggtgaacctgcagaacggcatcctgttcgtgaacagcagaatcgacagagaggagctgtgcggcagaagcgccgagtgcagcatccacctggaggtgatcgtggagagacccctgcaggtgttccacgtggacgtggaggtgaaggacatcaacgacaacccccccgtgttccccgccacccagagaaacctgttcatcgccgagagcagacccctggacagcagattccccctggagggcgccagcgacgccgacatcggcgagaacgccctgctgacctacagactgagccccaacgagtacttcttcctggacgtgcccaccagcaaccagcaggtgaagcccctgggcctggtgctgagaaagctgctggacagagaggagacccccgagctgcacctgctgctgaccgccaccgacggcggcaagcccgagctgaccggcaccgtgcagctgctgatcaccgtgctggacaacaacgacaacgcccccgtgttcgacagaaccctgtacaccgtgaagctgcccgagaacgtgagcatcggcaccctggtgatccaccccaacgccagcgacctggacgagggcctgaacggcgacatcatctacagcttcagcagcgacgtgagccccgacatcaagagcaagttccacatggaccccctgagcggcgccatcaccgtgatcggccacatggacttcgaggagagcagagcccacaagatccccgtggaggccgtggacaagggcttcccccccctggccggccactgcaccgtgctggtggaggtggtggacgtgaacgacaacgccccccagctgaccctgaccagcctgagcctgcccatccccgaggacgcccagcccggcaccgtgatcaccctgatcagcgtgttcgacagagacttcggcgtgaacggccaggtgacctgcagcctgacccccagagtgcccttcaagctggtgagcaccttcaagaactactacagcctggtgctggacagcgccctggacagagagagcgtgagcgcctacgagctggtggtgaccgccagagacggcggcagccccagcctgtgggccaccgccagcgtgagcgtggaggtggccgacgtgaacgacaacgcccccgccttcgcccagcccgagtacaccgtgttcgtgaaggagaacaacccccccggctgccacatcttcaccgtgagcgccggcgacgccgacgcccagaagaacgccctggtgagctacagcctggtggagctgagagtgggcgagagagccctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggcccccagagtgggcggcaccggcggcgccgtgagagagctggtgcccagaagcgtgggcgccggccacgtggtggccaaggtgagagccgtggacgccgacagcggctacaacgcctggctgagctacgagctgcagcccgtggccgccggcgccagcatccccttcagagtgggcctgtacaccggcgagatcagcaccaccagagccctggacgagaccgacgcccccagacacagactgctggtgctggtgaaggaccacggcgagcccagcctgaccgccaccgccaccgtgctggtgagcctggtggagagcggccaggcccccaaggccagcagcagagccagcctgggcatcgccggccccgagaccgagctggtggacgtgaacgtgtacctgatcatcgccatctgcgccgtgagcagcctgctggtgctgaccctgctgctgtacaccgccctgagatgcagcgcccccagcagcgagggcgcctgcagcctggtgaagcccaccctggtgtgcagcagcgccgtgggcagctggagcttcagccagcagagaagacagagagtgtgcagcggcgagggcccccccaagaccgacctgatggccttcagccccagcctgccccagggccccagcagcaccgacaaccccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95713 - DNA, 2445 bp, Artificial Sequence
  Description of Artificial Sequence: Synthetic coding sequence
atggactaccactggagaggcgagctgggcagctggagactgctgctgctgctgctgctgctggccgcctggaaggtgggcagcggccagctgcactacagcgtgcccgaggaggccaagcacggcaccttcgtgggcagaatcgcccaggacctgggcctggagctggccgagctggtgcccagactgttcagagtggccagcaagagacacagagacctgctggaggtgagcctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgaaggacgtgaacgacaacccccccgtgttcagagtgaaggaccagaagctgttcgtgagcgagagcagaatgcccgacagcagattccccctggagggcgccagcgacgccgacgtgggcgccaacagcgtgctgacctacagactgagcagccacgactacttcatgctggacgtgaacagcaagaacgacgagaacaagctggtggagctggtgctgagaaagagcctggacagagaggacgcccccgcccaccacctgttcctgaccgccaccgacggcggcaagcccgagctgaccggcaccgtgcagctgctggtgaccgtgctggacgtgaacgacaacgcccccaccttcgagcagagcgagtacgaggtgagaatcttcgagaacgccgacaacggcaccaccgtgatcaagctgaacgccagcgaccccgacgagggcgccaacggcgccatcagctacagcttcaacagcctggtggagaccatggtgatcgaccacttcagcatcgacagaaacaccggcgagatcgtgatcagaggcaacctggacttcgagcaggagaacctgtacaagatcctgatcgacgccaccgacaagggccacccccccatggccggccactgcaccgtgctggtgagaatcctggacaagaacgacaacgtgcccgagatcgccctgaccagcctgagcctgcccgtgagagaggacgcccagttcggcaccgtgatcgccctgatcagcgtgaacgacctggacagcggcgccaacggccaggtgacctgcagcctgatgccccacgtgcccttcaagctggtgagcaccttcaagaactactacagcctggtgctggacagcgccctggacagagagagagtgagcgcctacgagctggtggtgaccgccagagacggcggcagccccagcctgtgggccaccgccagcctgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagaagcctgagcagctacatcagcgtgcacaccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggagcccagagtgggcggcaccggcggcgccgccagcaagctggtgcccagaagcgtgggcgccggccacgtggtggccaaggtgagagccgtggacgccgacagcggctacaacgcctggctgagctacgagctgcagcccgccgccagcagccccagaatccccttcagagtgggcctgtacaccggcgagatcagcaccaccagagtgctggacgaggccgacagccccagacacagactgctggtgctggtgaaggaccacggcgagcccgccctgaccgccaccgccaccgtgctggtgagcctggtggagagcggccaggcccccaaggccagcagcagacagagcgccggcgtgctgggccccgaggccgccctggtggacgtgaacgtgtacctgatcatcgccatctgcgccgtgagcagcctgctggtgctgaccctgctgctgtacaccgccctgagatgcagcgccctgcccaccgagggcggctgcagagccggcaagcccaccctggtgtgcagcagcgccgtgggcagctggagctacagccagcagcagccccagagagtgtgcagcggcgagggcccccccaagaccgacctgatggccttcagcccctgcctgccccccgacctgggcagcgtggacgtgggcgaggagcaggacctgaacgtggaccacggcctgaaggtgagccccttcaagttcagaacccacaagttctacctgtggaagctgtag

SEQ ID NO: 95714 - DNA, 2853 bp, Artificial Sequence
  Description of Artificial Sequence: Synthetic coding sequence
atggactaccactggagaggcgagctgggcagctggagactgctgctgctgctgctgctgctggccgcctggaaggtgggcagcggccagctgcactacagcgtgcccgaggaggccaagcacggcaccttcgtgggcagaatcgcccaggacctgggcctggagctggccgagctggtgcccagactgttcagagtggccagcaagagacacagagacctgctggaggtgagcctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgaaggacgtgaacgacaacccccccgtgttcagagtgaaggaccagaagctgttcgtgagcgagagcagaatgcccgacagcagattccccctggagggcgccagcgacgccgacgtgggcgccaacagcgtgctgacctacagactgagcagccacgactacttcatgctggacgtgaacagcaagaacgacgagaacaagctggtggagctggtgctgagaaagagcctggacagagaggacgcccccgcccaccacctgttcctgaccgccaccgacggcggcaagcccgagctgaccggcaccgtgcagctgctggtgaccgtgctggacgtgaacgacaacgcccccaccttcgagcagagcgagtacgaggtgagaatcttcgagaacgccgacaacggcaccaccgtgatcaagctgaacgccagcgaccccgacgagggcgccaacggcgccatcagctacagcttcaacagcctggtggagaccatggtgatcgaccacttcagcatcgacagaaacaccggcgagatcgtgatcagaggcaacctggacttcgagcaggagaacctgtacaagatcctgatcgacgccaccgacaagggccacccccccatggccggccactgcaccgtgctggtgagaatcctggacaagaacgacaacgtgcccgagatcgccctgaccagcctgagcctgcccgtgagagaggacgcccagttcggcaccgtgatcgccctgatcagcgtgaacgacctggacagcggcgccaacggccaggtgacctgcagcctgatgccccacgtgcccttcaagctggtgagcaccttcaagaactactacagcctggtgctggacagcgccctggacagagagagagtgagcgcctacgagctggtggtgaccgccagagacggcggcagccccagcctgtgggccaccgccagcctgagcgtggaggtggccgacgtgaacgacaacgcccccgccttcgcccagcccgagtacaccgtgttcgtgaaggagaacaacccccccggctgccacatcttcaccgtgagcgccagagacgccgacgcccaggagaacgccctggtgagctacagcctggtggagagaagagtgggcgagagaagcctgagcagctacatcagcgtgcacaccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctggagcccagagtgggcggcaccggcggcgccgccagcaagctggtgcccagaagcgtgggcgccggccacgtggtggccaaggtgagagccgtggacgccgacagcggctacaacgcctggctgagctacgagctgcagcccgccgccagcagccccagaatccccttcagagtgggcctgtacaccggcgagatcagcaccaccagagtgctggacgaggccgacagccccagacacagactgctggtgctggtgaaggaccacggcgagcccgccctgaccgccaccgccaccgtgctggtgagcctggtggagagcggccaggcccccaaggccagcagcagacagagcgccggcgtgctgggccccgaggccgccctggtggacgtgaacgtgtacctgatcatcgccatctgcgccgtgagcagcctgctggtgctgaccctgctgctgtacaccgccctgagatgcagcgccctgcccaccgagggcggctgcagagccggcaagcccaccctggtgtgcagcagcgccgtgggcagctggagctacagccagcagcagccccagagagtgtgcagcggcgagggcccccccaagaccgacctgatggccttcagcccctgcctgccccccgacctgggcagcgtggacgtgggcgaggagcaggacctgaacgtggaccacggcctgaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95715 - DNA, 2529 bp, Artificial Sequence
  Description of Artificial Sequence: Synthetic coding sequence
atgctgtacagcagcagaggcgaccccgagggccagcccctgctgctgagcctgctgatcctggccatgtgggtggtgggcagcggccagctgcactacagcgtgcccgaggaggccgagcacggcaccttcgtgggcagaatcgcccaggacctgggcctggagctggccgagctggtgcccagactgttccagctggacagcaagggcagaggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgaaggacatcaacgacaacccccccgtgttccccgccacccagaagaacctgttcatcgccgagagcagacccctggacagcagattccccctggagggcgccagcgacgccgacatcggcgagaacgccctgctgacctacagactgagccccaacgagtacttcttcctggacgtgcccaccagcaaccagcaggtgaagcccctgggcctggtgctgagaaagctgctggacagagaggagacccccgagctgcacctgctgctgaccgccaccgacggcggcaagcccgagctgaccggcaccgtgcagctgctgatcaccgtgctggacaacaacgacaacgcccccgtgttcgacagaaccctgtacaccgtgaagctgcccgagaacgtgagcatcggcaccctggtgatccaccccaacgccagcgacctggacgagggcctgaacggcgacatcatctacagcttcagcagcgacgtgagccccgacatcaagagcaagttccacatggaccccctgagcggcgccatcaccgtgatcggccacatggacttcgaggagagcagagcccacaagatccccgtggaggccgtggacaagggcttcccccccctggccggccactgcaccctgctggtggaggtggtggacgtgaacgacaacgccccccagctgaccatcaagaccctgagcgtgcccgtgaaggaggacgcccagctgggcaccgtgatcgccctgatcagcgtgatcgacctggacgccgacgccaacggccaggtgacctgcagcctgaccccccacgtgcccttcaagctggtgagcacctacaagaactactacagcctggtgctggacagagccctggacagagagagcgtgagcgcctacgagctggtggtgaccgccagagacggcggcagccccagcctgtgggccaccgccagagtgagcgtggaggtggccgacgtgaacgacaacgcccccgccttcgcccagagcgagtacaccgtgttcgtgaaggagaacaacccccccggctgccacatcttcaccgtgagcgccagagacgccgacgcccaggagaacgccctggtgagctacagcctggtggagagaagactgggcgagagaagcctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctgacccccagaatgagaggcaccgacggcgccgtgagcgagatggtgctgagaagcgtgggcgccggcgtggtggtgggcaaggtgagagccgtggacgccgacagcggctacaacgcctggctgagctacgagctgcagcccgagaccgccagcgccagcatccccttcagagtgggcctgtacaccggcgagatcagcaccaccagagccctggacgagaccgacgcccccagacagagactgctggtgctggtgaaggaccacggcgagcccgccctgaccgccaccgccaccgtgctggtgagcctggtggagagcggccaggcccccaagagcagcagcagagccagcgtgggcgccaccggccccgaggtgaccctggtggacgtgaacgtgtacctgatcatcgccatctgcgccgtgagcagcctgctggtgctgaccctgctgctgtacaccgtgctgagatgcagcgccatgcccaccgagggcgagtgcgcccccggcaagcccaccctggtgtgcagcagcgccgtgggcagctggagctacagccagcagagaagacagagagtgtgcagcggcgagggcaagcagaagaccgacctgatggccttcagccccggcctgagcccctgcgccggcagcaccgagagaaccggcgagcccagcgccagcagcgacagcaccggcaaggtgggcttcagcagcatcctgttcatctacatcatcttcttcctggagagatactacagactgctgcccggcgccgtgcagatcgtgctgttcatcttcctggagatccagcagatcttcttcctgatcaagtag

SEQ ID NO: 95716 - DNA, 2853 bp, Artificial Sequence
  Description of Artificial Sequence: Synthetic coding sequence
atgctgtacagcagcagaggcgaccccgagggccagcccctgctgctgagcctgctgatcctggccatgtgggtggtgggcagcggccagctgcactacagcgtgcccgaggaggccgagcacggcaccttcgtgggcagaatcgcccaggacctgggcctggagctggccgagctggtgcccagactgttccagctggacagcaagggcagaggcgacctgctggaggtgaacctgcagaacggcatcctgttcgtgaacagcagaatcgacagagaggagctgtgcggcagaagcgccgagtgcagcatccacctggaggtgatcgtggacagacccctgcaggtgttccacgtggacgtggaggtgaaggacatcaacgacaacccccccgtgttccccgccacccagaagaacctgttcatcgccgagagcagacccctggacagcagattccccctggagggcgccagcgacgccgacatcggcgagaacgccctgctgacctacagactgagccccaacgagtacttcttcctggacgtgcccaccagcaaccagcaggtgaagcccctgggcctggtgctgagaaagctgctggacagagaggagacccccgagctgcacctgctgctgaccgccaccgacggcggcaagcccgagctgaccggcaccgtgcagctgctgatcaccgtgctggacaacaacgacaacgcccccgtgttcgacagaaccctgtacaccgtgaagctgcccgagaacgtgagcatcggcaccctggtgatccaccccaacgccagcgacctggacgagggcctgaacggcgacatcatctacagcttcagcagcgacgtgagccccgacatcaagagcaagttccacatggaccccctgagcggcgccatcaccgtgatcggccacatggacttcgaggagagcagagcccacaagatccccgtggaggccgtggacaagggcttcccccccctggccggccactgcaccctgctggtggaggtggtggacgtgaacgacaacgccccccagctgaccatcaagaccctgagcgtgcccgtgaaggaggacgcccagctgggcaccgtgatcgccctgatcagcgtgatcgacctggacgccgacgccaacggccaggtgacctgcagcctgaccccccacgtgcccttcaagctggtgagcacctacaagaactactacagcctggtgctggacagagccctggacagagagagcgtgagcgcctacgagctggtggtgaccgccagagacggcggcagccccagcctgtgggccaccgccagagtgagcgtggaggtggccgacgtgaacgacaacgcccccgccttcgcccagagcgagtacaccgtgttcgtgaaggagaacaacccccccggctgccacatcttcaccgtgagcgccagagacgccgacgcccaggagaacgccctggtgagctacagcctggtggagagaagactgggcgagagaagcctgagcagctacgtgagcgtgcacgccgagagcggcaaggtgtacgccctgcagcccctggaccacgaggagctggagctgctgcagttccaggtgagcgccagagacgccggcgtgccccccctgggcagcaacgtgaccctgcaggtgttcgtgctggacgagaacgacaacgcccccgccctgctgacccccagaatgagaggcaccgacggcgccgtgagcgagatggtgctgagaagcgtgggcgccggcgtggtggtgggcaaggtgagagccgtggacgccgacagcggctacaacgcctggctgagctacgagctgcagcccgagaccgccagcgccagcatccccttcagagtgggcctgtacaccggcgagatcagcaccaccagagccctggacgagaccgacgcccccagacagagactgctggtgctggtgaaggaccacggcgagcccgccctgaccgccaccgccaccgtgctggtgagcctggtggagagcggccaggcccccaagagcagcagcagagccagcgtgggcgccaccggccccgaggtgaccctggtggacgtgaacgtgtacctgatcatcgccatctgcgccgtgagcagcctgctggtgctgaccctgctgctgtacaccgtgctgagatgcagcgccatgcccaccgagggcgagtgcgcccccggcaagcccaccctggtgtgcagcagcgccgtgggcagctggagctacagccagcagagaagacagagagtgtgcagcggcgagggcaagcagaagaccgacctgatggccttcagccccggcctgagcccctgcgccggcagcaccgagagaaccggcgagcccagcgccagcagcgacagcaccggcaagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95717 - DNA, 2892 bp, Artificial Sequence
  Description of Artificial Sequence: Synthetic coding sequence
atggtgggctgcggcgtggccgtgctgtgcctgtgggtgagctgcggcgccgccgccggccagctggagtacagcgtgcccgaggagaccgagagaggcgtggccgtgggcaacctgagcgccgacctgagactgcccgccgccgccatgagcagcagaaacttcagattcctgagcagccacagagagctgtacttcggcgtggacctgcccagcggcaacctggtggtgagagagcccgccgacagagagcagctgtgcagagccaaggccgcctgcgtgctgacctacgacctggtgctggaggaccccctggagctgcacaagatcagaatccacgtgctggacaccaacgacaacagccccctgttccccgccggcgacgtgcagctgcacatccccgagttcctgacccccggcgccagattcaccctgcccaacgcccaggacgacgacgagggcagcaacggcatcctgagctacagcctgagccccagccagcacttcagactggacatgggcagcagagtggacggcagcgagtaccccgagctggtgctggagaaggccctggacagagagcagagagccacccacctgctggtgctgaccgccagagacggcggcctgcccgccagaagcggcgacgcccaggtgaccatcatcgtggtggacaccaacgacaacgcccccgtgttcgagagaagcgtgtacagaaccaaggtgcccgagaccgcccccaacggcaccgtgctgttcagagtgcaggccctggaccccgacgagggcagcaacggcgaggtgcagtacagcctgagcaacagcacccaggccgagctgagacacagattccacgtgcaccccaagagcggcgaggtgcaggtggccgccagcctgggcccccccgagaccctgctggaggcctacatcgaggccagagacgagggcgtgttcggcctggccagcaccgccaagctgctggtggaggtgaccgacgtgaacgaccacgcccccgagctggacttcctgaccctgagcaaccccgtgcccgaggacgccgcccccggcaccgtgatcgccctgttcagcgtgaaggacgaggacctggacagcaacggcagagtgatctgcggcatgagcagcgccggccccttccagctgaccgccagcttcgacaactactacagcctgctgatcgacggccccctggacagagagcagatcagcgagtaccaggtgctgatcaccgccagcgacagcggcagcccccccctgagcaccagaagaaccatcaccgtgagcgtggccgacgtgaacgacaacacccccaacttcccccagccccagcaggagctgttcgtggccgagaacaacggccccggcgccagcctgggcagagtgttcgcccaggaccccgacctgggcaagaacggcctggtgagctacgagctgctggacgtgatcagcgagggccccagcgccagcagcctgctggccgtggagagcagcagcggcgccatcaccgccaagaccagcttcgacttcgagcagctgagaggcttccacttccaggtggagggcagagacggcggcatcccccccagaagcgccaccgtgaccatcaacctgttcgtggtggacagaaacgacaactaccccgtgatcctgttccccctgcccagaaacggcagcgtgcccgtggagatcgtgcccagaagcgccagaaccggccacctggtgaccaaggtggtggccgaggacgccgacagcggcagcaacgcctggctgagctaccacatcagcagagccagcgacagcagcctgttcagaatcagcgccaacatcggcgagctgagaaccgccagactggtgctgcccaccgacgccgtgaagcagagagtggtggtggtggtgagagaccacggcgacccccccctgagcagcagcgtgaccctgggcgtgctgctgagcaacagcgtgccccagctgctgcccgacttcgaggacgtgtgggagcccggcggccagctgagcgcccagaacctgtacctggtgatcgccctggcctgcatcagcttcctgttcctgggctgcctgctgttcttcgtgtgcaccaagctgcaccagagccccggctgctgcgcccagagctgctgcagaagcaccgaggacctgagatacggcagcaagatggtgagcaacccctgcatgaccagcgccaccatcgacgtgaccaccgtggagagactgagccagacctacctgtacagagccagcctgggcctgggcagcgacaacaacagcctgctgctgagaggcgagtacaacgccgccgacctgagaaacctggccaccggcgtgggcctgaacctgcccatcagctgcatccagatcagaaacagaaagggcgaccacgccaacgtgaacgccatgcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95718 - DNA, 2457 bp, Artificial Sequence
  Description of Artificial Sequence: Synthetic coding sequence
atggtgggctgcggcgtggccgtgctgtgcctgtgggtgagctgcggcgccgccgccggccagctggagtacagcgtgcccgaggagaccgagagaggcgtggccgtgggcaacctgagcgccgacctgagactgcccgccgccgccatgagcagcagaaacttcagattcctgagcagccacagagagctgtacttcggcgtggacctgcccagcggcaacctggtggtgagagagcccgccgacagagagcagctgtgcagagccaaggccgcctgcgtgctgacctacgacctggtgctggaggaccccctggagctgcacaagatcagaatccacgtgctggacaccaacgacaacagccccctgttccccgccggcgacgtgcagctgcacatccccgagttcctgacccccggcgccagattcaccctgcccaacgcccaggacgacgacgagggcagcaacggcatcctgagctacagcctgagccccagccagcacttcagactggacatgggcagcagagtggacggcagcgagtaccccgagctggtgctggagaaggccctggacagagagcagagagccacccacctgctggtgctgaccgccagagacggcggcctgcccgccagaagcggcgacgcccaggtgaccatcatcgtggtggacaccaacgacaacgcccccgtgttcgagagaagcgtgtacagaaccaaggtgcccgagaccgcccccaacggcaccgtgctgttcagagtgcaggccctggaccccgacgagggcagcaacggcgaggtgcagtacagcctgagcaacagcacccaggccgagctgagacacagattccacgtgcaccccaagagcggcgaggtgcaggtggccgccagcctgggcccccccgagaccctgctggaggcctacatcgaggccagagacgagggcgtgttcggcctggccagcaccgccaagctgctggtggaggtgaccgacgtgaacgaccacgcccccgagctggacttcctgaccctgagcaaccccgtgcccgaggacgccgcccccggcaccgtgatcgccctgttcagcgtgaaggacgaggacctggacagcaacggcagagtgatctgcggcatgagcagcgccggccccttccagctgaccgccagcttcgacaactactacagcctgctgatcgacggccccctggacagagagcagatcagcgagtaccaggtgctgatcaccgccagcgacagcggcagcccccccctgagcaccagaagaaccatcaccgtgagcgtggccgacgtgaacgacaacacccccaacttcccccagccccagcaggagctgttcgtggccgagaacaacggccccggcgccagcctgggcagagtgttcgcccaggaccccgacctgggcaagaacggcctggtgagctacgagctgctggacgtgatcagcgagggccccagcgccagcagcctgctggccgtggagagcagcagcggcgccatcaccgccaagaccagcttcgacttcgagcagctgagaggcttccacttccaggtggagggcagagacggcggcatcccccccagaagcgccaccgtgaccatcaacctgttcgtggtggacagaaacgacaactaccccgtgatcctgttccccctgcccagaaacggcagcgtgcccgtggagatcgtgcccagaagcgccagaaccggccacctggtgaccaaggtggtggccgaggacgccgacagcggcagcaacgcctggctgagctaccacatcagcagagccagcgacagcagcctgttcagaatcagcgccaacatcggcgagctgagaaccgccagactggtgctgcccaccgacgccgtgaagcagagagtggtggtggtggtgagagaccacggcgacccccccctgagcagcagcgtgaccctgggcgtgctgctgagcaacagcgtgccccagctgctgcccgacttcgaggacgtgtgggagcccggcggccagctgagcgcccagaacctgtacctggtgatcgccctggcctgcatcagcttcctgttcctgggctgcctgctgttcttcgtgtgcaccaagctgcaccagagccccggctgctgcgcccagagctgctgcagaagcaccgaggacctgagatacggcagcaagatggtgagcaacccctgcatgaccagcgccaccatcgacgtgaccaccgtggagagactgagccagacctacctgtacagagccagcctgggcctgggcagcgacaacaacagcctgctgctgagaggcgagtacaacgccgccgacctgagaaacctggccaccggcgtgggcctgaacctgcccatcagctgcatccagatcagaaacagaaagggcgaccacgccaacgtgaacgccatggtgagcaagttctacggcatctag

SEQ ID NO: 95719 - DNA, 3024 bp, Artificial Sequence
  Description of Artificial Sequence: Synthetic coding sequence
atggagcaggccggcaccagacccgccgccaccgagcaccccagactgagaagacccatgccctggctgctgctgctgcccctgctgctgctgctgctgctgctgctgcccggccccgccgccagccagctgagatacagcgtgcccgaggagcaggcccccggcgccctggtgggcaacgtggccagagccctgggcctggagctgagaagactgggccccggctgcctgagaatcaaccacctgggcgcccccagccccagatacctggagctggacctgaccagcggcgccctgttcgtgaacgagagaatcgacagagaggccctgtgcgagcagagacccagatgcctgctgagcctggaggtgctggcccacaaccccgtggccgtgagcgccgtggaggtggagatcctggacatcaacgacaacagccccagattccccagacccaactaccagctgcaggtgagcgagagcgtggcccccggcgccagattccacatcgagagcgcccaggaccccgacgtgggcgccaacagcgtgcagacctacgagctgagccccagcgagcacttcgagctggacctgaagcccctgcaggagaacagcaaggtgctggagctggtgctgagaaagggcctggacagagagcaggccgccctgcaccacctggtgctgaccgccgtggacggcggcatccccgccagaagcggcaccgcccagatcagcgtgagagtgctggacaccaacgacaacagccccgccttcgaccagagcacctacagagtgcagctgagagaggacagcccccccggcaccctggtggtgaagctgaacgccagcgaccccgacgagggcagcaacggcgagctgagatacagcctgagcagctacaccagcgacagagagagacagctgttcagcatcgacgccagcaccggcgaggtgagagtgatcggcggcctggactacgaggaggccagcagctaccagatctacgtgcaggccaccgacagaggccccgtgcccatggccggccactgcaaggtgctggtggacatcgtggacgtgaacgacaacgcccccgaggtggtgctgaccgacctgtacagccccgtgcccgagaacgccacccccaacaccatcgtggccgtgctgagcgtgaacgaccaggacagcggccccaacagaaaggtgagcctgggcctggaggccaccctgcccttcagactgaacggcttcggcaacagctacaccctggtggtgagcggccccctggacagagagagagtggccgtgtacaacatcaccgtgaccgccaccgacggcggcatcccccagctgaccagcctgagaaccctgaaggtggagatcagcgacatcaacgacaacccccccagcttcctggaggacagctacagcatctacatccaggagaacaacctgcccggcgtgctgctgtgcaccgtgcaggccaccgaccccgacgagaaggagaacgccgaggtgacctacagcctgctggagagagagatccagggcctgcccgtgaccagctacgtgagcatcaacagcgccagcggcagcctgtacgccgtgaacagcttcgactacgagaagttcagagagttcttcgtgaccgtggaggcccaggacaagggcagcccccccctgagcagcaccgtgaccgccaacgtgtacgtggtggacatgaacgaccacgccccccacatcctgtaccccaccagcaccaacagcagcgccgccttcgagatggtgcccagaaccgcccccgccggctacctggtgaccaaggtgatcgccatggacagcgacagcggccagaacgcctggctgttctaccacctggcccagaccagcgacctggacctgttcaaggtggagctgcacaccggcgagatcagaaccaccagaaagatgggcgacgagagcggcagcaccttcaacctgaccgtggtggtgagagacaacggcgagcccagcctgagcgccagcgtggccatcaccgtggccgtggtggacagagtgagcaagatcctgcccgacacccagagacacgtgaagagccccagaacctacagcgagatcaccctgtacctgatcatcgccctgagcaccgtgagcttcatcttcctgctgaccatcatcatcctgagcatcatcaagtgctacagatacaccgcctacggcaccgcctgctgcggcggcttctgcggcgtgagagagagaagccccgccgagctgtacaagcaggccaacaacaacatcgacgccagaatcccccacggcctgaaggtgcagccccacttcatcgaggtgagaggcaacggcagcctgaccaagacctactgctacaaggcctgcctgaccgccggcagcggcagcgacaccttcatgttctacaacaccggcgcccagaccggccccggccccagcggcgcccaggccgccgtgaccgacagcagaaacctgaccggccagagcggccagaacgccggcaacctgatcatcctgaagaacgaggccgtgagccagaacgagcccagacagcccaaccccgactggagatacagcgccagcctgagagccggcatgcacagcagcgtgcacctggaggaggccggcatcctgagagccggccccggcggccccgaccagcagtggcccaccgtgagcagcgccacccccgagcccgaggccggcgaggtgagcccccccgtgggcgccggcgtgaacagcaacagctggaccttcaagtacggccccggcaaccccaagcagagcggccccggcgagctgcccgacaagttcatcatccccggcagccccgccatcatcagcatcagacaggagcccaccaacagccagatcgacaagagcgacttcatcaccttcggcaagaaggaggagaccaagaagaagaagaagaagaagaagggcaacaagacccaggagaagaaggagaagggcaacagcaccaccgacaacagcgaccagtag

SEQ ID NO: 95720 - DNA, 2457 bp, Artificial Sequence
  Description of Artificial Sequence: Synthetic coding sequence
atggccggcaccagaagaaagagcctgcagaacagacaggtgggcagcctgctgatcttcctgtgcatcagcgtgggcgacgccaccaccatcagatacagcgtggccgaggagatggagagcggcagcttcgtggccaacgtggccaaggacctgggcctggaggtgggcaagctggccgccagaggcgccagactggtgagcgagggcaacaagatgcacttcagactgcacagaaagaccggcgacctgttcgtgaaggagaagctggacagagagagcctgtgcggcaaggccgacccctgcgtgctgcacttcgaggtggtgctggtggagcccctgcagagcttcagagccgaggtgagagtgttcgacatcaacgacaacgcccccgtgttcctgaacaaggagcccctgctgaagatccccgagagcacccccctgggcagcagattccccctgcagagcgcccaggacctggacgtgggcctgaacggcctgcagaactacaccctgagcgccaacggctacttccacctgcacaccagattctgcagccacggccccaagtacgccgagctggtgctgaacaagcccctggacagagaggagcagcccgaggtgaacctgaccatcaccgccgtggacggcggcagcccccccaagagcggcaccgcccacatccacgtggtggtgctggacgtgaacgaccacgtgccccagttcagcagactggtgtacagagcccaggtgagcgagaacagccccaacggcagcctggtggccaccgtgaccgccgtggacctggacgagggcaccaacaaggccatcacctacagcctggcccagaaccccgaggccatcctgaagaccttccagatcgacccccagaacggcgaggtgagactgagaggccccctggacttcgaggccatcgagacctacgacatcgacatccaggccaccgacggcggcggcctgagcgcccacagcaaggtgctggtggaggtggtggacgtgaacgacaacccccccgaggtgatggtgagcagcgtgagcagccccctgcccgaggacagccccccccagaccgtggtggccctgttcaccatcagagacagagacatcagagtgggcggcaaggtgacctgcttcctgagagaggacctgcccttcgtgatcaagcccaccttcggcaacagctacagcctggtgaccgacagaagcctggacagagaggaggtgagcggctacaacatcaccatcgtggccatggacaccggcccccccagcctgagcgccgagaccatgatcgaggtgctgatcagcgacgtgaacgacaacccccccatcttcagagaggacagctacatcctgaccgtgagagagaacaacagccccgccgtgttcatcggcaaggtgcacgccgaggacctggacctgggcgagaacgcccagatcacctacagcctgctgccccccaagaacggcgacctgagcgtgttcgcctacatcagcatcaacagcggcaacggcaagctgtacgccctgagaaccatggactacgaggccatccaggacttccagttcgtggtgaaggccaccgacggcggcttcctgagcctgagcagccaggtgaccgtgagagtggtggtgctggacgacaacgacaacagacccatgatcctgtaccccctgcagaacggcaccctgccctgcaacgacctggtgcccagaagcgccgaggccggctacctggtgaccaaggtggtggccgtggacggcgacagcggccagaacagctggctgagctaccacctgctgaaggccaccgacctgggcctgttcagcgtgcagagacagaacggcgagatccacaccctgagacagatcagcgagagagaccccatgatgcagaagctgatcatcctggtgcaggaccacggccagcccgccctgagcaccaccgtgagcctgaacatcctgctggtggacggcttcagcgagccctacctgcagttccaggaccccaccaagcacagcagaaaggtgaaccccagcaccaagtacctggtgatcagcctggtgatcctgagcttcctgttcctgctgagcgtgatcgtgatcttcatcatccacgtgtaccagaagatcaagtacagagagaagttcaccatccaggagcacttctacgacgactgcaacttcagcaacaacctggtgcagggccagggcaacggcagcctgagcagaccctgcccctacgagatgtgcagcgccaccggcaccggcaacagcgagttcagattcctgaagagattcatgcccaacttccccttcccccacgccaccggcgagatcaagatggaggccggcagcagcctgccccccaacagcgacagaaacaagagccagagactggagggccacgaccaggtgagcgacgactacatgtag

SEQ ID NO: 95721 - DNA, 2394 bp, Artificial Sequence
  Description of Artificial Sequence: Synthetic coding sequence
atggagaaccagggcaccagaacccagcagatcagacaggtgctgctgctgttcgtgctgctgggcatgagccaggccggcagcgagacctggagcttcagcgtggccgaggagatgcagagcggcagcttcgtgggcaacctggccaaggacctgggcctgaaggtgagagagctgagcagcagaggcgccagagtggtgagcaacgacaagaagcagagactgcagctggacatcaacaccggcgacctgctgctgagcgagaccctggacagagaggagctgtgcggcagcatcgagccctgcgtgctgcacctgcaggtgctgatgcagaaccccacccagttcctgcagatcgagctgcaggtgagagacatcaacgaccacagccccatcttcagcgagaagcagatgctgctggagatccccgagaacagccccgtgggcgccgtgttcctgctggagagcgccaaggacctggacgtgggcatcaacgccgtgaagagctacaccatcagccccaacagccacttccacatcaagatgagagtgatccccgacaacagaaagtaccccgagctggtgctggacaaggccctggactacgaggagctgcccgagctgagcttcatcctgagcgccctggacggcggcagcccccccagaagcggcaccgccctggtgagagtggtggtggtggacatcaacgacaacagccccgagttcgagcaggccttctacgaggtgaagatcagagagaacagcatcctgggcagcctgatcctgatcgtgagcgcctgggacctggacagcggcaccaacggcgagatctgctacaccttcagccacgccagcgaggacatcagaaagaccttcgagatcaaccagaagagcggcgagatcaccctgagagcccccctggacttcgagaccatcgagagctacagcatcatcatccaggccaccgacggcggcggcctgttcggcaagagcaccgtgatcatccacgtgatcgacgtgaacgacaacgcccccgagatcaccgtgagcagcatcaccagccccatccccgagaacacccccgagaccgtggtgatggtgttcagcatccaggacatcgacagcggcgacaacggcagaatcgtgtgcagcatccccgaggacctgcccttcgtgctgaagagcagcgtggagaactactacaccctggagaccgagagacccctggacagagagagcaccgccgagtacaacatcaccatcaccgtgaccgacctgggcatccccagactgaagaccgagcacaacaccaccgtgctggtgagcgacgtgaacgacaacgcccccaccttcacccagaccagctacaccctgttcgtgagagagaacaacagccccgccctgcacatcggcagcgtgagcgccaccgacagagacagcggcaccaacgcccaggtgaactacagcctgctgcccccccaggacctgcacctgcccctggccagcctggtgagcatcaacaccgacaacggccacctgttcgccctgagaagcctggactacgaggccctgcaggccttcgacttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcaggtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagctgcagcgtgcccaagggccccttccccggccacctggtggacgtgagcggcaccggcaccctgagccagagctaccagtacgaggtgtgcctgaccggcggcagcgagaccaacgagttcaagttcctgaagcccgtgatccccaacatccaggccaagggcctgggcaagaacagcgaggagaacagcaccttcagaaacagcttcggcttcaacttctag

SEQ ID NO: 95722 - DNA, 1299 bp, Artificial Sequence
  Description of Artificial Sequence: Synthetic coding sequence
atggtgttcagcatccaggacatcgacagcggcgacaacggcagaatcgtgtgcagcatccccgaggacctgcccttcgtgctgaagagcagcgtggagaactactacaccctggagaccgagagacccctggacagagagagcaccgccgagtacaacatcaccatcaccgtgaccgacctgggcatccccagactgaagaccgagcacaacaccaccgtgctggtgagcgacgtgaacgacaacgcccccaccttcacccagaccagctacaccctgttcgtgagagagaacaacagccccgccctgcacatcggcagcgtgagcgccaccgacagagacagcggcaccaacgcccaggtgaactacagcctgctgcccccccaggacctgcacctgcccctggccagcctggtgagcatcaacaccgacaacggccacctgttcgccctgagaagcctggactacgaggccctgcaggccttcgacttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcaggtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagctgcagcgtgcccaagggccccttccccggccacctggtggacgtgagcggcaccggcaccctgagccagagctaccagtacgaggtgtgcctgaccggcggcagcgagaccaacgagttcaagttcctgaagcccgtgatccccaacatccaggccaagggcctgggcaagaacagcgaggagaacagcaccttcagaaacagcttcggcttcaacttctag

SEQ ID NO: 95723 - DNA, 399 bp, Artificial Sequence
  Description of Artificial Sequence: Synthetic coding sequence
accatcgagagctacagcatcatcatccaggccaccgacggcggcggcctgttcggcaagagcaccgtgatcatccacgtgatcgacgtgaacgacaacgcccccgagatcaccgtgagcagcatcaccagccccatccccgagaacacccccgagaccgtggtgatggtgttcagcatccaggacatcgacggcaccaccgaggagctgttcgtgcccttcagaaagaccagccacgtgctgaagagcagcgtggagaactactacaccctggagaccgagagacccctggacagagagagcaccgccgagtacaacatcaccatcaccgtgaccgacctgggcatccccagactgaagaccgagcacaacaccaccgtgctggtgagcgacgtgtag

SEQ ID NO: 95724 - DNA, 2388 bp, Artificial Sequence
  Description of Artificial Sequence: Synthetic coding sequence
atggagaacggcggcgccggcaccctgcagatcagacaggtgctgctgttcttcgtgctgctgggcatgagccaggccggcagcgagaccggcaacttcctggtgatggaggagctgcagagcggcagcttcgtgggcaacctggccaagaccctgggcctggaggtgagcgagctgagcagcagaggcgccagagtggtgagcaacgacaacaaggagtgcctgcagctggacaccaacaccggcgacctgctgctgagagagatgctggacagagaggagctgtgcggcagcaacgagccctgcgtgctgtacttccaggtgctgatgaagaaccccacccagttcctgcagatcgagctgcaggtgagagacatcaacgaccacagccccgtgttcctggagaaggagatgctgctggagatccccgagaacagccccgtgggcgccgtgttcctgctggagagcgccaaggacctggacgtgggcatcaacgccgtgaagagctacaccatcaaccccaacagccacttccacgtgaagatcagagtgaaccccgacaacagaaagtaccccgagctggtgctggacaaggccctggactacgaggagagacccgagctgagcttcatcctgaccgccctggacggcggcagcccccccagaagcggcaccgccctggtgagagtggtggtggtggacatcaacgacaacagccccgagttcgagcaggccttctacgaggtgaagatcctggagaacagcatcctgggcagcctggtggtgaccgtgagcgcctgggacctggacagcggcaccaacagcgagctgagctacaccttcagccacgccagcgaggacatcagaaagaccttcgagatcaaccagaagagcggcgacatcaccctgaccgcccccctggacttcgaggccatcgagagctacagcatcatcatccaggccaccgacggcggcggcctgttcggcaagagcaccgtgagaatccaggtgatggacgtgaacgacaacgcccccgagatcaccgtgagcagcatcaccagccccatccccgagaacacccccgagaccgtggtgatggtgttcagaatcagagacagagacagcggcgacaacggcaagatggtgtgcagcatccccgaggacatccccttcgtgctgaagagcagcgtgaacaactactacaccctggagaccgagagacccctggacagagagagcagagccgagtacaacatcaccatcaccgtgaccgacctgggcacccccagactgaagaccgagcacaacatcaccgtgctggtgagcgacgtgaacgacaacgcccccgccttcacccagaccagctacgccctgttcgtgagagagaacaacagccccgccctgcacatcggcagcatcagcgccaccgacagagacagcggcaccaacgcccaggtgaactacagcctgctgcccagccaggacccccacctgcccctggccagcctggtgagcatcaacgccgacaacggccacctgttcgccctgagaagcctggactacgaggccctgcagggcttccagttcagagtgggcgccaccgaccacggcagccccgccctgagcagcgaggccctggtgagagtgctggtgctggacgccaacgacaacagccccttcgtgctgtaccccctgcagaacggcagcgccccctgcaccgagctggtgccctgggccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgcccccgtgggcagatgcagcgtgcccgagggccccttccccggccacctggtggacgtgagcggcaccggcaccctgagccagagctaccactacgaggtgtgcgtgaccggcggcagcagaagcaacaagttcaagttcctgaagcccatcatccccaacttcctgccccagagcaccggcagcgaggtggaggagaacccccccttccagaacaacctgggcttctag

SEQ ID NO: 95725 - DNA, 1257 bp, Artificial Sequence
  Description of Artificial Sequence: Synthetic coding sequence
atggtgtgcagcatccccgaggacatccccttcgtgctgaagagcagcgtgaacaactactacaccctggagaccgagagacccctggacagagagagcagagccgagtacaacatcaccatcaccgtgaccgacctgggcacccccagactgaagaccgagcacaacatcaccgtgctggtgagcgacgtgaacgacaacgcccccgccttcacccagaccagctacgccctgttcgtgagagagaacaacagccccgccctgcacatcggcagcatcagcgccaccgacagagacagcggcaccaacgcccaggtgaactacagcctgctgcccagccaggacccccacctgcccctggccagcctggtgagcatcaacgccgacaacggccacctgttcgccctgagaagcctggactacgaggccctgcagggcttccagttcagagtgggcgccaccgaccacggcagccccgccctgagcagcgaggccctggtgagagtgctggtgctggacgccaacgacaacagccccttcgtgctgtaccccctgcagaacggcagcgccccctgcaccgagctggtgccctgggccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgcccccgtgggcagatgcagcgtgcccgagggccccttccccggccacctggtggacgtgagcggcaccggcaccctgagccagagctaccactacgaggtgtgcgtgaccggcggcagcagaagcaacaagttcaagttcctgaagcccatcatccccaacttcctgccccagagcaccggcagcgaggtggaggagaacccccccttccagaacaacctgggcttctggatccagtag

SEQ ID NO: 95726 - DNA, 1377 bp, Artificial Sequence
  Description of Artificial Sequence: Synthetic coding sequence
atggacgtgaacgacaacgcccccgagatcaccgtgagcagcatcaccagccccatccccgagaacacccccgagaccgtggtgatggtgttcagaatcagagacagagacagcggcgacaacggcaagatggtgtgcagcatccccgaggacatccccttcgtgctgaagagcagcgtgaacaactactacaccctggagaccgagagacccctggacagagagagcagagccgagtacaacatcaccatcaccgtgaccgacctgggcacccccagactgaagaccgagcacaacatcaccgtgctggtgagcgacgtgaacgacaacgcccccgccttcacccagaccagctacgccctgttcgtgagagagaacaacagccccgccctgcacatcggcagcatcagcgccaccgacagagacagcggcaccaacgcccaggtgaactacagcctgctgcccagccaggacccccacctgcccctggccagcctggtgagcatcaacgccgacaacggccacctgttcgccctgagaagcctggactacgaggccctgcagggcttccagttcagagtgggcgccaccgaccacggcagccccgccctgagcagcgaggccctggtgagagtgctggtgctggacgccaacgacaacagccccttcgtgctgtaccccctgcagaacggcagcgccccctgcaccgagctggtgccctgggccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgcccccgtgggcagatgcagcgtgcccgagggccccttccccggccacctggtggacgtgagcggcaccggcaccctgagccagagctaccactacgaggtgtgcgtgaccggcggcagcagaagcaacaagttcaagttcctgaagcccatcatccccaacttcctgccccagagcaccggcagcgaggtggaggagaacccccccttccagaacaacctgggcttctag

SEQ ID NO: 95727 - DNA, 2397 bp, Artificial Sequence
  Description of Artificial Sequence: Synthetic coding sequence
atggaggccagcggcaagctgatctgcagacagagacaggtgctgttcagcttcctgctgctgggcctgagcctggccggcgccgccgagcccagaagctacagcgtggtggaggagaccgagggcagcagcttcgtgaccaacctggccaaggacctgggcctggagcagagagagttcagcagaagaggcgtgagagtggtgagcagaggcaacaagctgcacctgcagctgaaccaggagaccgccgacctgctgctgaacgagaagctggacagagaggacctgtgcggccacaccgagccctgcgtgctgagattccaggtgctgctggagagccccttcgagttcttccaggccgagctgcaggtgatcgacatcaacgaccacagccccgtgttcctggacaagcagatgctggtgaaggtgagcgagagcagcccccccggcaccaccttccccctgaagaacgccgaggacctggacgtgggccagaacaacatcgagaactacatcatcagccccaacagctacttcagagtgctgaccagaaagagaagcgacggcagaaagtaccccgagctggtgctggacaaggccctggacagagaggaggaggccgagctgagactgaccctgaccgccctggacggcggcagcccccccagaagcggcaccgcccaggtgtacatcgaggtgctggacgtgaacgacaacgcccccgagttcgagcagcccttctacagagtgcagatcagcgaggacagccccgtgggcttcctggtggtgaaggtgagcgccaccgacgtggacaccggcgtgaacggcgagatcagctacagcctgttccaggccagcgaggagatcggcaagaccttcaagatcaaccccctgaccggcgagatcgagctgaagaagcagctggacttcgagaagctgcagagctacgaggtgaacatcgaggccagagacgccggcaccttcagcggcaagtgcaccgtgctgatccaggtgatcgacgtgaacgaccacgcccccgaggtgaccatgagcgccttcaccagccccatccccgagaacgcccccgagaccgtggtggccctgttcagcgtgagcgacctggacagcggcgagaacggcaagatcagctgcagcatccaggaggacctgcccttcctgctgaagagcgccgagaacttctacaccctgctgaccgagagacccctggacagagagagcagagccgagtacaacatcaccatcaccgtgaccgacctgggcacccccatgctgatcacccagctgaacatgaccgtgctgatcgccgacgtgaacgacaacgcccccgccttcacccagaccagctacaccctgttcgtgagagagaacaacagccccgccctgcacatcagaagcgtgagcgccaccgacagagacagcggcaccaacgcccaggtgacctacagcctgctgcccccccaggacccccacctgcccctgaccagcctggtgagcatcaacgccgacaacggccacctgttcgccctgagaagcctggactacgaggccctgcagggcttccagttcagagtgggcgccagcgaccacggcagccccgccctgagcagcgaggccctggtgagagtggtggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagctgggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccacccaggcccaggccgacctgctgaccgtgtacctggtggtggccctggccagcgtgagcagcctgttcctgttcagcgtgctgctgttcgtggccgtgagactgtgcagaagaagcagagccgccagcgtgggcagatgcctggtgcccgagggccccctgcccggccacctggtggacatgagcggcaccagaaccctgagccagagctaccagtacgaggtgtgcctggccggcggcagcggcaccaacgagttcaagttcctgaagcccatcatccccaacttccccccccagtgccccggcaaggagatccagggcaacagcaccttccccaacaacttcggcttcaacatccagtag

SEQ ID NO: 95728 - DNA, 2235 bp, Artificial Sequence
  Description of Artificial Sequence: Synthetic coding sequence
atggaggccagcggcaagctgatctgcagacagagacaggtgctgttcagcttcctgctgctgggcctgagcctggccggcgccgccgagcccagaagctacagcgtggtggaggagaccgagggcagcagcttcgtgaccaacctggccaaggacctgggcctggagcagagagagttcagcagaagaggcgtgagagtggtgagcagaggcaacaagctgcacctgcagctgaaccaggagaccgccgacctgctgctgaacgagaagctggacagagaggacctgtgcggccacaccgagccctgcgtgctgagattccaggtgctgctggagagccccttcgagttcttccaggccgagctgcaggtgatcgacatcaacgaccacagccccgtgttcctggacaagcagatgctggtgaaggtgagcgagagcagcccccccggcaccaccttccccctgaagaacgccgaggacctggacgtgggccagaacaacatcgagaactacatcatcagccccaacagctacttcagagtgctgaccagaaagagaagcgacggcagaaagtaccccgagctggtgctggacaaggccctggacagagaggaggaggccgagctgagactgaccctgaccgccctggacggcggcagcccccccagaagcggcaccgcccaggtgtacatcgaggtgctggacgtgaacgacaacgcccccgagttcgagcagcccttctacagagtgcagatcagcgaggacagccccgtgggcttcctggtggtgaaggtgagcgccaccgacgtggacaccggcgtgaacggcgagatcagctacagcctgttccaggccagcgaggagatcggcaagaccttcaagatcaaccccctgaccggcgagatcgagctgaagaagcagctggacttcgagaagctgcagagctacgaggtgaacatcgaggccagagacgccggcaccttcagcggcaagtgcaccgtgctgatccaggtgatcgacgtgaacgaccacgcccccgaggtgaccatgagcgccttcaccagccccatccccgagaacgcccccgagaccgtggtggccctgttcagcgtgagcgacctggacagcggcgagaacggcaagatcagctgcagcatccaggaggacctgcccttcctgctgaagagcgccgagaacttctacaccctgctgaccgagagacccctggacagagagagcagagccgagtacaacatcaccatcaccgtgaccgacctgggcacccccatgctgatcacccagctgaacatgaccgtgctgatcgccgacgtgaacgacaacgcccccgccttcacccagaccagctacaccctgttcgtgagagagaacaacagccccgccctgcacatcagaagcgtgagcgccaccgacagagacagcggcaccaacgcccaggtgacctacagcctgctgccccccagagtggtggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagctgggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccacccaggcccaggccgacctgctgaccgtgtacctggtggtggccctggccagcgtgagcagcctgttcctgttcagcgtgctgctgttcgtggccgtgagactgtgcagaagaagcagagccgccagcgtgggcagatgcctggtgcccgagggccccctgcccggccacctggtggacatgagcggcaccagaaccctgagccagagctaccagtacgaggtgtgcctggccggcggcagcggcaccaacgagttcaagttcctgaagcccatcatccccaacttccccccccagtgccccggcaaggagatccagggcaacagcaccttccccaacaacttcggcttcaacatccagtag

SEQ ID NO: 95729 - DNA, 2409 bp, Artificial Sequence
  Description of Artificial Sequence: Synthetic coding sequence
atggaggccagcggcaagctgatctgcagacagagacaggtgctgttcagcttcctgctgctgggcctgagcctggccggcgccgccgagcccagaagctacagcgtggtggaggagaccgagggcagcagcttcgtgaccaacctggccaaggacctgggcctggagcagagagagttcagcagaagaggcgtgagagtggtgagcagaggcaacaagctgcacctgcagctgaaccaggagaccgccgacctgctgctgaacgagaagctggacagagaggacctgtgcggccacaccgagccctgcgtgctgagattccaggtgctgctggagagccccttcgagttcttccaggccgagctgcaggtgatcgacatcaacgaccacagccccgtgttcctggacaagcagatgctggtgaaggtgagcgagagcagcccccccggcaccaccttccccctgaagaacgccgaggacctggacgtgggccagaacaacatcgagaactacatcatcagccccaacagctacttcagagtgctgaccagaaagagaagcgacggcagaaagtaccccgagctggtgctggacaaggccctggacagagaggaggaggccgagctgagactgaccctgaccgccctggacggcggcagcccccccagaagcggcaccgcccaggtgtacatcgaggtgctggacgtgaacgacaacgcccccgagttcgagcagcccttctacagagtgcagatcagcgaggacagccccgtgggcttcctggtggtgaaggtgagcgccaccgacgtggacaccggcgtgaacggcgagatcagctacagcctgttccaggccagcgaggagatcggcaagaccttcaagatcaaccccctgaccggcgagatcgagctgaagaagcagctggacttcgagaagctgcagagctacgaggtgaacatcgaggccagagacgccggcaccttcagcggcaagtgcaccgtgctgatccaggtgatcgacgtgaacgaccacgcccccgaggtgaccatgagcgccttcaccagccccatccccgagaacgcccccgagaccgtggtggccctgttcagcgtgagcgacctggacagcggcgagaacggcaagatcagctgcagcatccaggaggacctgcccttcctgctgaagagcgccgagaacttctacaccctgctgaccgagagacccctggacagagagagcagagccgagtacaacatcaccatcaccgtgaccgacctgggcacccccatgctgatcacccagctgaacatgaccgtgctgatcgccgacgtgaacgacaacgcccccgccttcacccagaccagctacaccctgttcgtgagagagaacaacagccccgccctgcacatcagaagcgtgagcgccaccgacagagacagcggcaccaacgcccaggtgacctacagcctgctgcccccccaggacccccacctgcccctgaccagcctggtgagcatcaacgccgacaacggccacctgttcgccctgagaagcctggactacgaggccctgcagggcttccagttcagagtgggcgccagcgaccacggcagccccgccctgagcagcgaggccctggtgagagtggtggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagctgggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccacccaggcccaggccgacctgctgaccgtgtacctggtggtggccctggccagcgtgagcagcctgttcctgttcagcgtgctgctgttcgtggccgtgagactgtgcagaagaagcagagccgccagcgtgggcagatgcctggtgcccgagggccccctgcccggccacctggtggacatgagcggcaccagaaccctgagccagagctaccagtacgaggtgtgcctggccggcggcagcggcaccaacgagttcaagttcctgaagcccatcatccccaacttccccccccagtgccccggcaaggagatccagggcaacagcaccttccccaacctgtgcgtgtgcaacatcgtgagaatctacagctag

SEQ ID NO: 95730 - DNA, 2397 bp, Artificial Sequence
  Description of Artificial Sequence: Synthetic coding sequence
atggagatcagaggcgccctggacctgagaaagagacaggtgctgatcttcctggtgctgctgggcctgagcagagccggcaccgagagcgcccactacagcgtggccgaggagaccgagatcggcagcttcgtggccaacctggccagagacctgggcctgggcgtggaggagctgagcagcagagaggccagagtggtgagcgacgacaacaagaagtacctgcacctggacctgctgaccggcaacctgctgctgaacgagaagctggacagagacgagctgtgcggcagcaccgagccctgcgtgctgcacttccaggtggtgctggagaaccccctgcagttcttcagattcgagctgtgcgtgaaggacatcaacgaccacagccccaccttcctggacaaggagatcctgatcaagatcagcgagggcaccaccgtgggcgccaccttcctgatggagagcgcccaggacctggacgtgggcagcaacagcctgcagaactacaccatcagccccaacagccacttctacatcaagatccccgacagcagcgacagaaagatctaccccgagctggtgctggacagagccctggactacgagcaggaggccgagctgagactgaccctgaccgccgtggacggcggcagcccccccaagagcggcaccaccctggtgctgatcaaggtgctggacatcaacgacaacgcccccgagttcccccagagcctgtacgaggtgcaggtgcccgaggacagacccctgggcagctggatcgccaccatcagcgccaaggacctggacgccggcaactacggcaagatcagctacaccttcttccacgccagcgaggacatcagaaagaccttcgagatcaaccccatcagcggcgaggtgaacctgagaagccccctggacttcgaggtgatccagagctacaccatcaacatccaggccaccgacggcggcggcctgagcggcaagtgcaccctgctggtgaaggtgatggacatcaacgacaacccccccgaggtgaccatcagcagcatcaccaagagaatccccgagaacgccagcgagaccctggtggccctgttcagcatcctggaccaggacagcggcgacaacggcagaatgatctgcagcatccaggacaacctgcccttcttcctgaagcccaccttcaagaacttcttcaccctggtgagcgagaaggccctggacagagagagccaggccgagtacaacatcaccatcaccgtgaccgacctgggcacccccagactgaagaccgagtacaacatcaccgtgctgctgagcgacgtgaacgacaacgcccccaccttcacccagaccagctacaccctgttcgtgagagagaacaacagccccgccctgcacatcggcagcgtgagcgccaccgacagagacagcggcaccaacgcccaggtgaactacagcctgctgcccccccaggacagacacctgcccctggccagcctggtgagcatcaacgccgacaacggccacctgttcgccctgagaagcctggactacgaggccctgcaggagttcgagttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccacctggtggacgtgagcggcaccggcaccctgagccagagctaccagtacgaggtgtgcctgaccggcggcagcggcaccaacgagttcaagttcctgaagcccatcatccccaacttccaggtgcacgacaccggcagaaacatgggcgagatcgagaacttcagaaacagcttcggcctgaacatccagtag

SEQ ID NO: 95731 - DNA, 1938 bp, Artificial Sequence
  Description of Artificial Sequence: Synthetic coding sequence
atggagagcgcccaggacctggacgtgggcagcaacagcctgcagaactacaccatcagccccaacagccacttctacatcaagatccccgacagcagcgacagaaagatctaccccgagctggtgctggacagagccctggactacgagcaggaggccgagctgagactgaccctgaccgccgtggacggcggcagcccccccaagagcggcaccaccctggtgctgatcaaggtgctggacatcaacgacaacgcccccgagttcccccagagcctgtacgaggtgcaggtgcccgaggacagacccctgggcagctggatcgccaccatcagcgccaaggacctggacgccggcaactacggcaagatcagctacaccttcttccacgccagcgaggacatcagaaagaccttcgagatcaaccccatcagcggcgaggtgaacctgagaagccccctggacttcgaggtgatccagagctacaccatcaacatccaggccaccgacggcggcggcctgagcggcaagtgcaccctgctggtgaaggtgatggacatcaacgacaacccccccgaggtgaccatcagcagcatcaccaagagaatccccgagaacgccagcgagaccctggtggccctgttcagcatcctggaccaggacagcggcgacaacggcagaatgatctgcagcatccaggacaacctgcccttcttcctgaagcccaccttcaagaacttcttcaccctggtgagcgagaaggccctggacagagagagccaggccgagtacaacatcaccatcaccgtgaccgacctgggcacccccagactgaagaccgagtacaacatcaccgtgctgctgagcgacgtgaacgacaacgcccccaccttcacccagaccagctacaccctgttcgtgagagagaacaacagccccgccctgcacatcggcagcgtgagcgccaccgacagagacagcggcaccaacgcccaggtgaactacagcctgctgcccccccaggacagacacctgcccctggccagcctggtgagcatcaacgccgacaacggccacctgttcgccctgagaagcctggactacgaggccctgcaggagttcgagttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccacctggtggacgtgagcggcaccggcaccctgagccagagctaccagtacgaggtgtgcctgaccggcggcagcggcaccaacgagttcaagttcctgaagcccatcatccccaacttccaggtgcacgacaccggcagaaacatgggcgagatcgagaacttcagaaacagcttcggcctgaacatccagtag

SEQ ID NO: 95732 - DNA, 2382 bp, Artificial Sequence
  Description of Artificial Sequence: Synthetic coding sequence
atggaggccagagtggagagagccgtgcagaagagacaggtgctgttcctgtgcgtgttcctgggcatgagctgggccggcgccgagcccctgagatacttcgtggccgaggagaccgagagaggcaccttcctgaccaacctggccaaggacctgggcctgggcgtgggcgagctgagagccagaggcaccagaatcgtgagcgaccagaacatgcagatcctgctgctgagcagcctgaccggcgacctgctgctgaacgagaagctggacagagaggagctgtgcggccccagagagccctgcgtgctgcccttccagctgctgctggagaagcccttccagatcttcagagccgagctgtgggtgagagacatcaacgaccacgcccccgtgttcctggacagagagatcagcctgaagatcctggagagcaccacccccggcgccgccttcctgctggagagcgcccaggacagcgacgtgggcaccaacagcctgagcaactacaccatcagccccaacgcctacttccacatcaacgtgcacgacagcggcgagggcaacatctaccccgagctggtgctgaaccaggtgctggacagagaggagatccccgagttcagcctgaccctgaccgccctggacggcggcagcccccccagaagcggcaccgccctggtgagaatcctggtgctggacgtgaacgacaacgcccccgacttcgtgagaagcctgtacaaggtgcaggtgcccgagaacagccccgtgggcagcatggtggtgagcgtgagcgccagagacctggacaccggcagcaacggcgagatcgcctacgccttcagctacgccaccgagagaatcctgaagaccttccagatcaaccccaccagcggcagcctgcacctgaaggcccagctggactacgaggccatccagacctacaccctgaccatccaggccaaggacggcggcggcctgagcggcaagtgcaccgtggtggtggacgtgaccgacatcaacgacaacagacccgagctgctgctgagcagcctgaccagccccatcgccgagaacagccccgagaccgtggtggccgtgttcagaatcagagacagagacagcggcaacaacggcaagaccgtgtgcagcatccaggacgacgtgcccttcatcctgaagcccagcgtggagaacttctacaccctggtgaccgagaagcccctggacagagagagaaacaccgagtacaacatcaccatcaccgtgaccgacctgggcacccccagactgaagaccgagcacaacatcaccgtgctggtgagcgacgtgaacgacaacgcccccgccttcacccagaccagctacaccctgttcgtgagagagaacaacagccccgccctgcccatcggcagcgtgagcgccaccgacagagacagcggcaccaacgcccaggtgatctacagcctgctgcccagccaggacccccacctgcccctggccagcctggtgagcatcaacgccgacaacggccacctgttcgccctgagaagcctggactacgaggccctgcaggccttcgagttcagagtgggcgccaccgacagaggcagccccgccctgagcagcgaggccctggtgagagtgctggtgctggacgccaacgacaacagccccttcgtgctgtaccccctgcagaacagcagcgccccctgcaccgagcccctgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcagagactggtggtgctggtgaaggacaacggcgagccccccagaagcgccaccgccaccctgcacgtgctgctggtggacggcttcagccagccctacctgagactgcccgaggccgcccccgaccaggccaacagcctgaccgtgtacctggtggtggccctggccagcgtgagcagcctgttcctgctgagcgtgctgctgttcgtggccgtgagactgtgcagaagaagcagagccgcccccgtgggcagatgcagcgtgcccgagggccccttccccagacacctggtggacctgagcggcaccggcaccctgagccagagctaccagtacgaggtgtgcctgaccggcggcagcggcaccaacgagttcaagttcctgaagcccatcatccccaacctgctgccccagagcaccggcagagaggtggaggagaacagacccttccagaacaacctgggcttctag

SEQ ID NO: 95733 - DNA, 2331 bp, Artificial Sequence
  Description of Artificial Sequence: Synthetic coding sequence
atggagatcggctggatgcacaacagaagacagagacaggtgctggtgttcttcgtgctgctgagcctgagcggcgccggcgccgagctgggcagctacagcgtggtggaggagaccgagagaggcagcttcgtggccaacctgggcaaggacctgggcctgggcctgaccgagatgagcaccagaaaggccagaatcatcagccagggcaacaagcagcacctgcagctgaaggcccagaccggcgacctgctgatcaacgagaagctggacagagaggagctgtgcggccccaccgagccctgcatcctgcacttccaggtgctgatggagaaccccctggagatcttccaggccgagctgagagtgatcgacatcaacgaccacagccccatgttcaccgagaaggagatgatcctgaagatccccgagaacagccccctgggcaccgagttccccctgaaccacgccctggacctggacgtgggcagcaacaacgtgcagaactacaagatcagccccagcagccacttcagagtgctgatccacgagttcagagacggcagaaagtaccccgagctggtgctggacaaggagctggacagagaggaggagccccagctgagactgaccctgaccgccctggacggcggcagcccccccagaagcggcaccgcccaggtgagaatcgaggtggtggacatcaacgacaacgcccccgagttcgagcagcccatctacaaggtgcagatccccgagaacagccccctgggcagcctggtggccaccgtgagcgccagagacctggacggcggcgccaacggcaagatcagctacaccctgttccagcccagcgaggacatcagcaagaccctggaggtgaaccccatgaccggcgaggtgagactgagaaagcaggtggacttcgagatggtgaccagctacgaggtgagaatcaaggccaccgacggcggcggcctgagcggcaagtgcaccctgctgctgcaggtggtggacgtgaacgacaaccccccccaggtgaccatgagcgccctgaccagccccatccccgagaacagccccgagatcgtggtggccgtgttcagcgtgagcgaccccgacagcggcaacaacggcaagaccatcagcagcatccaggaggacctgcccttcctgctgaagcccagcgtgaagaacttctacaccctggtgaccgagagagccctggacagagaggccagagccgagtacaacatcaccctgaccgtgaccgacatgggcacccccagactgaagaccgagcacaacatcaccgtgcagatcagcgacgtgaacgacaacgcccccaccttcacccagaccagctacaccctgttcgtgagagagaacaacagccccgccctgcacatcggcagcgtgagcgccaccgacagagacagcggcaccaacgcccaggtgacctacagcctgctgcccccccaggacccccacctgcccctggccagcctggtgagcatcaacgccgacaacggccacctgttcgccctgagaagcctggactacgaggccctgagagagttcgagttcagagtgagcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcagagactggtggtgctggtgaaggacaacggcgagccccccagaagcgccaccgccaccctgcacgtgctgctggtggacggcttcagccagcccttcctgcccctgcccgaggccgcccccggccagacccaggccaacagcctgaccgtgtacctggtggtggccctggccagcgtgagcagcctgttcctgttcagcgtgctgctgttcgtggccgtgagactgtgcagaagaagcagagccgccagcgtgggcagatgcagcatgcccgagggccccttccccggcagactggtggacgtgagcggcaccggcaccctgagccagagctaccagtacgaggtgtgcctgaccggcggcagcgagaccagcgagttcaagttcctgaagcccatcatccccaacttcagcccctag

SEQ ID NO: 95734 - DNA, 2397 bp, Artificial Sequence
  Description of Artificial Sequence: Synthetic coding sequence
atggaggccggcgagggcaaggagagagtgcccaagcagagacaggtgctgatcttcttcgtgctgctgggcatcgcccaggccagctgccagcccagacactacagcgtggccgaggagaccgagagcggcagcttcgtggccaacctgctgaaggacctgggcctggagatcggcgagctggccgtgagaggcgccagagtggtgagcaagggcaagaagatgcacctgcagttcgacagacagaccggcgacctgctgctgaacgagaagctggacagagaggagctgtgcggccccaccgagccctgcgtgctgcccttccaggtgctgctggagaaccccctgcagttcttccaggccgagctgagaatcagagacgtgaacgaccacagccccgtgttcctggacaaggagatcctgctgaagatccccgagagcatcacccccggcaccaccttcctgatcgagagagcccaggacctggacgtgggcaccaacagcctgcagaactacaccatcagccccaacttccacttccacctgaacctgcaggacagcctggacggcatcatcctgccccagctggtgctgaacagagccctggacagagaggagcagcccgagatcagactgaccctgaccgccctggacggcggcagcccccccagaagcggcaccgccctggtgagaatcgaggtggtggacatcaacgacaacgtgcccgagttcgccaagctgctgtacgaggtgcagatccccgaggacagccccgtgggcagccaggtggccatcgtgagcgccagagacctggacatcggcaccaacggcgagatcagctacgccttcagccaggccagcgaggacatcagaaagaccttcagactgagcgccaagagcggcgagctgctgctgagacagaagctggacttcgagagcatccagacctacaccgtgaacatccaggccaccgacggcggcggcctgagcggcacctgcgtggtgttcgtgcaggtgatggacctgaacgacaacccccccgagctgaccatgagcaccctgatcaaccagatccccgagaacctgcaggacaccctgatcgccgtgttcagcgtgagcgaccccgacagcggcgacaacggcagaatggtgtgcagcatccaggacgacctgcccttcttcctgaagcccagcgtggagaacttctacaccctggtgatcagcaccgccctggacagagagaccagaagcgagtacaacatcaccatcaccgtgaccgacttcggcacccccagactgaagaccgagcacaacatcaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccaggacccccacctgcccctggccagcctggtgagcatcaacgccgacaacggccacctgttcgccctgcagagcctggactacgaggccctgcaggccttcgagttcagagtgggcgccgccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagagagagagacgccgccaagcagagactggtggtgctggtgaaggacaacggcgagccccccagaagcgccaccgccaccctgcacgtgctgctggtggacggcttcagccagccctacctgctgctgcccgaggccgcccccgcccaggcccaggccgacctgctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccagatggtggacgtgagcggcaccggcaccctgagccagagctaccagtacgaggtgtgcctgaccggcggcagcggcaccaacgagttcaagttcctgaagcccatcatccccaacttcgtggcccagggcgccgagagagtgagcgaggccaaccccagcttcagaaagagcttcgagttcacctag

SEQ ID NO: 95735 - DNA, 648 bp, Artificial Sequence
  Description of Artificial Sequence: Synthetic coding sequence
atgaacctggtgggcagctacgcccaccaccaccaccaccaccacccccaccccgcccaccccatgctgcacgagcccttcctgttcggccccgccagcagatgccaccaggagagaccctacttccagagctggctgctgagccccgccgacgccgcccccgacttccccgccggcggccccccccccgccgccgccgccgccgccaccgcctacggccccgacgccagacccggccagagccccggcagactggaggccctgggcggcagactgggcagaagaaagggcagcggccccaagaaggagagaagaagaaccgagagcatcaacagcgccttcgccgagctgagagagtgcatccccaacgtgcccgccgacaccaagctgagcaagatcaagaccctgagactggccaccagctacatcgcctacctgatggacgtgctggccaaggacgcccagagcggcgaccccgaggccttcaaggccgagctgaagaaggccgacggcggcagagagagcaagagaaagagagagctgcagcagcacgagggcttcccccccgccctgggccccgtggagaagagaatcaagggcagaaccggctggccccagcaggtgtgggccctggagctgaaccagtag

SEQ ID NO: 95736 - DNA, 2388 bp, Artificial Sequence
  Description of Artificial Sequence: Synthetic coding sequence
atgaagaagctgggcagaatccaccccaacagacaggtgctggccttcatcctgatggtgttcctgagccaggtgagactggagcccatcagatacagcgtgctggaggagaccgagagcggcagcttcgtggcccacctggccaaggacctgggcctgggcatcggcgagctggccagcagaagcgccagagtgctgagcgacgacgacaagcagagactgcagctggacagacagaccggcgacctgctgctgagagagaagctggacagagaggagctgtgcggccccatcgagccctgcgtgctgcacttccaggtgttcctggagatgcccgtgcagttcttccagggcgagctgctgatccaggacatcaacgaccacagccccatcttccccgagagagaggtgctgctgaagatcctggagaacagccagcccggcaccctgttccccctgctgatcgccgaggacctggacgtgggcagcaacggcctgcagaagtacaccatcagccccaacagccacttccacatcctgaccagaaaccacagcgagggcaagaagtaccccgacctggtgcaggacaagcccctggacagagaggagcagcccgagttcagcctgaccctggtggccctggacggcggcagcccccccagaagcggcaccgtgatggtgagaatcctgatcatggacatcaacgacaacgcccccgagttcgtgcacaccccctacggcgtgcaggtgctggagaacagccccctggacagccccatcgtgagagtgctggccagagacatcgacgccggcaacttcggcagcgtgagctacggcctgttccaggccagcgacgagatcaagcagaccttcagcatcaacgaggtgaccggcgagatcctgctgaagaagaagctggacttcgagaagatcaagagctaccacgtggagatcgaggccaccgacggcggcggcctgagcggcaagggcaccgtggtgatcgaggtggtggacgtgaacgacaacccccccgagctgatcatcagcagcctgaccagcagcatccccgagaacgcccccgagaccgtggtgagcatcttcagaatcagagacagagacagcggcgagaacggcaagatgatctgcagcatccccgacaacctgcccttcatcctgaagcccaccctgaagaacttctacaccctggtgaccgagagacccctggacagagagaccagcgccgagtacaacatcaccatcgccgtgaccgacctgggcacccccagactgaagacccagcagaacatcaccgtgcaggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccaggacccccacctgcccctggccagcctggtgagcatcaacgccgacaacggccacctgttcgccctgagaagcctggactacgaggccctgcaggccttcgagttcagagtgggcgccagcgacagaggcagccccgccctgagcagcgaggccctggtgagagtgctggtgctggacaccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccacctggtggacgtgagcggcaccggcaccctgagccagagctaccagtacgaggtgtgcctgaccggcgacagcggcaccggcgagttcaagttcctgaagcccatcttccccaacctgctggtgcaggacaccggcagagaggtgaaggagaaccccaagttcagaaacagcctggtgttcagctag

SEQ ID NO: 95737 - DNA, 2391 bp, Artificial Sequence
  Description of Artificial Sequence: Synthetic coding sequence
atggaggccggcggcgagagattcctgagacagagacaggtgctgctgctgttcgtgttcctgggcggcagcctggccggcagcgagagcagaagatacagcgtggccgaggagaaggagaagggcttcctgatcgccaacctggccaaggacctgggcctgagagtggaggagctggccgccagaggcgcccaggtggtgagcaagggcaacaagcagcacttccagctgagccaccagaccggcgacctgctgctgaacgagaagctggacagagaggagctgtgcggccccaccgagccctgcatcctgcacttccagatcctgctgcagaaccccctgcagttcgtgaccaacgagctgagaatcatcgacgtgaacgaccacagccccgtgttcttcgagaacgagatgcacctgaagatcctggagagcaccctgcccggcaccgtgatccccctgggcaacgccgaggacctggacgtgggcagaaacagcctgcagaactacaccatcacccccaacagccacttccacgtgctgaccagaagcagaagagacggcagaaagtaccccgagctggtgctggacaaggccctggacagagaggagcagcccgagctgagcctgaccctgaccgccctggacggcggcagcccccccagaagcggcaccgcccagatcaacatccaggtgctggacatcaacgacaacgcccccgagttcgcccagcccctgtacgaggtggccgtgctggagaacacccccgtgaacagcgtgatcgtgaccgtgagcgccagcgacctggacaccggcagcttcggcaccatcagctacgccttcttccacgccagcgaggagatcagaaagaccttccagctgaaccccatcaccggcgacatgcagctggtgaagtacctgaacttcgaggccatcaacagctacgaggtggacatcgaggccaaggacggcggcggcctgagcggcaagagcaccgtgatcgtgcaggtggtggacgtgaacgacaacccccccgagctgaccctgagcagcgtgaacagccccatccccgagaacagcggcgagaccgtgctggccgtgttcagcgtgagcgacctggacagcggcgacaacggcagagtgatgtgcagcatcgagaacaacctgcccttcttcctgaagcccagcgtggagaacttctacaccctggtgagcgagggcgccctggacagagagaccagaagcgagtacaacatcaccatcaccatcaccgacctgggcacccccagactgaagaccaagtacaacatcaccgtgctggtgagcgacgtgaacgacaacgcccccgccttcacccagatcagctacaccctgttcgtgagagagaacaacagccccgccctgcacatcggcagcgtgagcgccaccgacagagacagcggcaccaacgcccaggtgacctacagcctgctgcccccccaggacccccacctgcccctgagcagcctggtgagcatcaacgccgacaacggccacctgttcgccctgagaagcctggactacgaggccctgcaggccttcgagttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacctgctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccagatggtggacgtgagcggcaccggcaccctgagccagagctaccagtacgaggtgtgcctgaccggcggcagcggcaccaacgagttcaagttcctgaagcccatcatccccaacttcgtggcccagggcgccgagagagtgagcgaggccaaccccagcttcagaaagagcttcgagttcagctag

SEQ ID NO: 95738 - DNA, 1107 bp, Artificial Sequence
  Description of Artificial Sequence: Synthetic coding sequence
ggcggcgccccccccagaagcggcaccaccaccatcagaatcgtggtgctggacaacaacgacaacgcccccgagttcctgcagagcttctacgaggtgcaggtgcccgagaacagccccctgaacagcctggtggtggtggtgagcgccagagacctggacgccggcgcctacggcagcgtggcctacgccctgttccagggcgacgaggtgacccagcccttcgtgatcgacgagaagaccgccgagatcagactgaagagagccctggacttcgaggccaccccctactacaacgtggagatcgtggccaccgacggcggcggcctgagcggcaagtgcaccgtggccatcgaggtggtggacgtgaacgacaacgcccccgagctgaccatgagcaccctgagcagccccacccccgagaacgcccccgagaccgtggtggccgtgttcagcgtgagcgaccccgacagcggcgacaacggcagaatgatctgcagcatccagaacgacctgcccttcctgctgaagcccaccctgaagaacttctacaccctggtgacccagagaaccctggacagagagagccaggccgagtacaacatcaccatcaccgtgaccgacatgggcacccccagactgaagaccgagcacaacatcaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccagaacccccacctgagactggccagcctggtgagcatcaacgccgacaacggccacctgttcgccctgagaagcctggactacgaggccctgcaggccttcgagttcagagtgggcgccaccgacagaggcagccccgccctgagcagcgaggccctggtgagagtgctgtgctggacccccaccaccaccagacccagctgctgcatcagatgcagaaccgccagaagactggcccccagctggtgccccggcagacccagcagagccacctggtag

SEQ ID NO: 95739 - DNA, 2388 bp, Artificial Sequence
  Description of Artificial Sequence: Synthetic coding sequence
atggagaccgccctggccaagaccccccagaagagacaggtgatgttcctggccatcctgctgctgctgtgggaggccggcagcgaggccgtgagatacagcatccccgaggagaccgagagcggctacagcgtggccaacctggccaaggacctgggcctgggcgtgggcgagctggccaccagaggcgccagaatgcactacaagggcaacaaggagctgctgcagctggacatcaagaccggcaacctgctgctgtacgagaagctggacagagaggtgatgtgcggcgccaccgagccctgcatcctgcacttccagctgctgctggagaaccccgtgcagttcttccagaccgacctgcagctgaccgacatcaacgaccacgcccccgagttccccgagaaggagatgctgctgaagatccccgagagcacccagcccggcaccgtgttccccctgaagatcgcccaggacttcgacatcggcagcaacaccgtgcagaactacaccatcagccccaacagccacttccacgtggccacccacaacagaggcgacggcagaaagtaccccgagctggtgctggacaaggccctggacagagaggagagacccgagctgagcctgaccctgaccgccctggacggcggcgccccccccagaagcggcaccaccaccatcagaatcgtggtgctggacaacaacgacaacgcccccgagttcctgcagagcttctacgaggtgcaggtgcccgagaacagccccctgaacagcctggtggtggtggtgagcgccagagacctggacgccggcgcctacggcagcgtggcctacgccctgttccagggcgacgaggtgacccagcccttcgtgatcgacgagaagaccgccgagatcagactgaagagagccctggacttcgaggccaccccctactacaacgtggagatcgtggccaccgacggcggcggcctgagcggcaagtgcaccgtggccatcgaggtggtggacgtgaacgacaacgcccccgagctgaccatgagcaccctgagcagccccacccccgagaacgcccccgagaccgtggtggccgtgttcagcgtgagcgaccccgacagcggcgacaacggcagaatgatctgcagcatccagaacgacctgcccttcctgctgaagcccaccctgaagaacttctacaccctggtgacccagagaaccctggacagagagagccaggccgagtacaacatcaccatcaccgtgaccgacatgggcacccccagactgaagaccgagcacaacatcaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccagaacccccacctgagactggccagcctggtgagcatcaacgccgacaacggccacctgttcgccctgagaagcctggactacgaggccctgcaggccttcgagttcagagtgggcgccaccgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcagcatgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatgcagcgtgcccgagggccccttccccggccacctggtggacgtgagcggcaccggcaccctgagccagagctaccactacgaggtgtgcctgaccggcgacagcggcgccggcgagttcaagttcctgaagcccatcatccccaacctgctgccccagggcgccggcgaggagatcggcaagaccgccgccttcagaaacagcttcggcctgaactag

SEQ ID NO: 95740 - DNA, 1107 bp, Artificial Sequence
  Description of Artificial Sequence: Synthetic coding sequence
ggcggcagcccccccagaagcggcaccagcgagatccagatccaggtgctggacatcaacgacaacgtgcccgagttcgcccaggagctgtacgaggcccaggtgcccgagaacaaccccctgggcagcctggtgatcaccgtgagcgccagagacctggacgccggcagcttcggcaaggtgagctacgccctgttccaggtggacgacgtgaaccagcccttcgagatcaacgccatcaccggcgagatcagactgagaaaggccctggacttcgaggagatccagagctacgacgtggacgtggaggccaccgacggcggcggcctgagcggcaagtgcagcctggtggtgagagtgctggacgtgaacgacaacgcccccgagctgaccatgagcttcttcatcagcctgatccccgagaacctgcccgagatcaccgtggccgtgttcagcgtgagcgacgccgacagcggccacaaccagcaggtgatctgcagcatcgagaacaacctgcccttcctgctgagacccagcgtggagaacttctacaccctggtgaccgagggcgccctggacagagagagcagagccgagtacaacatcaccatcaccgtgaccgacctgggcacccccagactgaagacccagcagagcatcaccgtgcaggtgagcgacgtgaacgacaacgtgcccgccttcacccagaccagctacaccctgttcgtgagagagaacaacagccccgccctgcacatcggcagcgtgagcgccaccgacagagacagcggcatcaacgcccaggtgacctacagcctgctgcccccccaggacccccacctgcccctgagcagcctggtgagcatcaacgccgacaacggccacctgttcgccctgagaagcctggactacgaggccctgcagagcttcgagttcagagtgggcgccaccgacagaggcagccccgccctgagcagcgaggccctggtgagactgctgtgctggacccccaccaccaccagacccagctgctgcaccagatgcagaaccgcccccagacccgcccccagctggtgccccggcagacccagcagagccacctggtag

SEQ ID NO: 95741 - DNA, 1977 bp, Artificial Sequence
  Description of Artificial Sequence: Synthetic coding sequence
atgctgctgaagatcagcgagatcaccatgcccggcaagatcttccccctgaagatggcccacgacctggacaccggcagcaacggcctgcagagatacaccatcagcagcaacccccacttccacgtgctgaccagaaacagaagcgagggcagaaagttccccgagctggtgctggacaagcccctggacagagaggagcagccccagctgagactgaccctgatcgccctggacggcggcagcccccccagaagcggcaccagcgagatccagatccaggtgctggacatcaacgacaacgtgcccgagttcgcccaggagctgtacgaggcccaggtgcccgagaacaaccccctgggcagcctggtgatcaccgtgagcgccagagacctggacgccggcagcttcggcaaggtgagctacgccctgttccaggtggacgacgtgaaccagcccttcgagatcaacgccatcaccggcgagatcagactgagaaaggccctggacttcgaggagatccagagctacgacgtggacgtggaggccaccgacggcggcggcctgagcggcaagtgcagcctggtggtgagagtgctggacgtgaacgacaacgcccccgagctgaccatgagcttcttcatcagcctgatccccgagaacctgcccgagatcaccgtggccgtgttcagcgtgagcgacgccgacagcggccacaaccagcaggtgatctgcagcatcgagaacaacctgcccttcctgctgagacccagcgtggagaacttctacaccctggtgaccgagggcgccctggacagagagagcagagccgagtacaacatcaccatcaccgtgaccgacctgggcacccccagactgaagacccagcagagcatcaccgtgcaggtgagcgacgtgaacgacaacgtgcccgccttcacccagaccagctacaccctgttcgtgagagagaacaacagccccgccctgcacatcggcagcgtgagcgccaccgacagagacagcggcatcaacgcccaggtgacctacagcctgctgcccccccaggacccccacctgcccctgagcagcctggtgagcatcaacgccgacaacggccacctgttcgccctgagaagcctggactacgaggccctgcagagcttcgagttcagagtgggcgccaccgacagaggcagccccgccctgagcagcgaggccctggtgagactgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagctgggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatacagcgtgcccgagggccccttccccggccacctggtggacgtgagcggcaccggcaccctgagccagagctaccagtacaaggtgtgcctgaccggcggcagcgagaccaacgagttcaagttcctgaagcccatcatgcccaacttccccccccagggcaccgagagagagatggaggagacccccaccagcagaaacagcttccccttcagctag

SEQ ID NO: 95742 - DNA, 2385 bp, Artificial Sequence
  Description of Artificial Sequence: Synthetic coding sequence
atgatgcagaccaaggtgcagaacaagaagagacaggtggccttcttcatcctgctgatgctgtggggcgaggtgggcagcgagagcatccagtacagcgtgctggaggagaccgagagcggcaccttcgtggccaacctgaccaaggacctgggcctgagagtgggcgagctggccagcagaggcgccagagtggtgttcaagggcaacagacagcacctgcagttcgacccccagacccacgacctgctgctgaacgagaagctggacagagaggagctgtgcggcagcaccgagccctgcgtgctgcccttccaggtgctgctggagaaccccctgcagttcttccaggccagcctgagagtgagagacatcaacgaccacgcccccgagttccccgccagagagatgctgctgaagatcagcgagatcaccatgcccggcaagatcttccccctgaagatggcccacgacctggacaccggcagcaacggcctgcagagatacaccatcagcagcaacccccacttccacgtgctgaccagaaacagaagcgagggcagaaagttccccgagctggtgctggacaagcccctggacagagaggagcagccccagctgagactgaccctgatcgccctggacggcggcagcccccccagaagcggcaccagcgagatccagatccaggtgctggacatcaacgacaacgtgcccgagttcgcccaggagctgtacgaggcccaggtgcccgagaacaaccccctgggcagcctggtgatcaccgtgagcgccagagacctggacgccggcagcttcggcaaggtgagctacgccctgttccaggtggacgacgtgaaccagcccttcgagatcaacgccatcaccggcgagatcagactgagaaaggccctggacttcgaggagatccagagctacgacgtggacgtggaggccaccgacggcggcggcctgagcggcaagtgcagcctggtggtgagagtgctggacgtgaacgacaacgcccccgagctgaccatgagcttcttcatcagcctgatccccgagaacctgcccgagatcaccgtggccgtgttcagcgtgagcgacgccgacagcggccacaaccagcaggtgatctgcagcatcgagaacaacctgcccttcctgctgagacccagcgtggagaacttctacaccctggtgaccgagggcgccctggacagagagagcagagccgagtacaacatcaccatcaccgtgaccgacctgggcacccccagactgaagacccagcagagcatcaccgtgcaggtgagcgacgtgaacgacaacgtgcccgccttcacccagaccagctacaccctgttcgtgagagagaacaacagccccgccctgcacatcggcagcgtgagcgccaccgacagagacagcggcatcaacgcccaggtgacctacagcctgctgcccccccaggacccccacctgcccctgagcagcctggtgagcatcaacgccgacaacggccacctgttcgccctgagaagcctggactacgaggccctgcagagcttcgagttcagagtgggcgccaccgacagaggcagccccgccctgagcagcgaggccctggtgagactgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagctgggcctgttcggcgtgtgggcccacaacggcgaggtgagaaccgccagactgctgagcgagagagacgccgccaagcacagactggtggtgctggtgaaggacaacggcgagccccccagaagcgccaccgccaccctgcacgtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgctgctgttcgtggccgtgagactgtgcagaagaagcagagccgccagcgtgggcagatacagcgtgcccgagggccccttccccggccacctggtggacgtgagcggcaccggcaccctgagccagagctaccagtacaaggtgtgcctgaccggcggcagcgagaccaacgagttcaagttcctgaagcccatcatgcccaacttccccccccagggcaccgagagagagatggaggagacccccaccagcagaaacagcttccccttcagctag

SEQ ID NO: 95743 - DNA, 1107 bp, Artificial Sequence
  Description of Artificial Sequence: Synthetic coding sequence
ggcagcccccccagaagcggcaccgccctggtgagaatcctggtgctggacgtgaacgacaacgcccccgacttcgtgagaagcctgtacaaggtgcaggtgcccgagaacagccccgtgggcagcatggtggtgagcgtgagcgccagagacctggacaccggcagcaacggcgagatcgcctacgccttcagctacgccaccgagagaatcctgaagaccttccagatcaaccccaccagcggcagcctgcacctgaaggcccagctggactacgaggccatccagacctacaccctgaccatccaggccaaggacggcggcggcctgagcggcaagtgcaccgtggtggtggacgtgaccgacatcaacgacaacagacccgagctgctgctgagcagcctgaccagccccatcgccgagaacagccccgagaccgtggtggccgtgttcagaatcagagacagagacagcggcaacaacggcaagaccgtgtgcagcatccaggacgacgtgcccttcatcctgaagcccagcgtggagaacttctacaccctggtgaccgagaagcccctggacagagagagaaacaccgagtacaacatcaccatcaccgtgaccgacctgggcacccccagactgaagaccgagcacaacatcaccgtgctggtgagcgacgtgaacgacaacgcccccgccttcacccagaccagctacaccctgttcgtgagagagaacaacagccccgccctgcccatcggcagcgtgagcgccaccgacagagacagcggcaccaacgcccaggtgatctacagcctgctgcccagccaggacccccacctgcccctggccagcctggtgagcatcaacgccgacaacggccacctgttcgccctgagaagcctggactacgaggccctgcaggccttcgagttcagagtgggcgccaccgacagaggcagccccgccctgagcagcgaggccctggtgagagtgctgtgctggacccccaccaccaccagacccagctgctgcaccagatgcagaaccgcccccagacccgcccccagcagatgccccggcagacccagcagagccacctggtag

SEQ ID NO: 95744 - DNA, 2406 bp, Artificial Sequence
  Description of Artificial Sequence: Synthetic coding sequence
atggaggccagcggcaagctgatctgcagacagagacaggtgctgttcagcttcctgctgctgggcctgagcctggccggcgccgccgagcccagaagctacagcgtggtggaggagaccgagggcagcagcttcgtgaccaacctggccaaggacctgggcctggagcagagagagttcagcagaagaggcgtgagagtggtgagcagaggcaacaagctgcacctgcagctgaaccaggagaccgccgacctgctgctgaacgagaagctggacagagaggacctgtgcggccacaccgagccctgcgtgctgagattccaggtgctgctggagagccccttcgagttcttccaggccgagctgcaggtgatcgacatcaacgaccacagccccgtgttcctggacaagcagatgctggtgaaggtgagcgagagcagcccccccggcaccgccttccccctgaagaacgccgaggacctggacatcggccagaacaacatcgagaactacatcatcagccccaacagctacttcagagtgctgaccagaaagagaagcgacggcagaaagtaccccgagctggtgctggacaaggccctggacagagaggaggaggccgagctgagactgaccctgaccgccctggacggcggcagcccccccagaagcggcaccgcccaggtgtacatcgaggtggtggacgtgaacgacaacgcccccgagttcgagcagcccttctacagagtgcagatcagcgaggacagccccatcagcttcctggtggtgaaggtgagcgccaccgacgtggacaccggcgtgaacggcgagatcagctacagcctgttccaggccagcgacgagatcagcaagaccttcaaggtggacttcctgaccggcgagatcagactgaagaagcagctggacttcgagaagttccagagctacgaggtgaacatcgaggccagagacgccggcggcttcagcggcaagtgcaccgtgctgatccaggtgatcgacgtgaacgaccacgcccccgaggtgaccatgagcgccttcaccagccccatccccgagaacgcccccgagaccgtggtggccctgttcagcgtgagcgacctggacagcggcgagaacggcaagatcagctgcagcatccaggaggacctgcccttcctgctgaagagcagcgtgggcaacttctacaccctgctgaccgagacccccctggacagagagagcagagccgagtacaacgtgaccatcaccgtgaccgacctgggcacccccagactgaccacccacctgaacatgaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgcccccccaggacccccacctgcccctggccagcctggtgagcatcaacaccgacaacggccacctgttcgccctgagaagcctggactacgaggccctgcaggccttcgagttcagagtgggcgccagcgacagaggcagccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgccgccaagcagagactggtggtgctggtgaaggacaacggcgagcccccctgcagcgccaccgccaccctgcacctgctgctggtggacggcttcagccagccctacctgcccctgcccgaggccgcccccgcccagggccaggccgacagcctgaccgtgtacctggtggtggccctggccagcgtgagcagcctgttcctgttcagcgtgctgctgttcgtggccgtgctgctgtgcagaagaagcagagccgccagcgtgggcagatgcagcgtgcccgagggccccttccccggccacctggtggacgtgagaggcaccggcagcctgagccagaactaccagtacgaggtgtgcctggccggcggcagcggcaccaacgagttccagttcctgaagcccgtgctgcccaacatccagggccacagcttcggccccgagatggagcagaacagcaacttcagaaacggcttcggcttcagcctgcagctgaagtag

SEQ ID NO: 95745 - DNA, 2472 bp, Artificial Sequence
  Description of Artificial Sequence: Synthetic coding sequence
atgaagatccagaagaagctgaccggctgcagcagactgatgctgctgtgcctgagcctggagctgctgctggaggccggcgccggcaacatccactacagcgtgcccgaggagaccgacaagggcagcttcgtgggcaacatcgccaaggacctgggcctgcagccccaggagctggccgacggcggcgtgagaatcgtgagcagaggcagaatgcccctgttcgccctgaaccccagaagcggcagcctgatcaccgccagaagaatcgacagagaggagctgtgcgcccagagcatgccctgcctggtgagcttcaacatcctggtggaggacaagatgaagctgttccccgtggaggtggagatcatcgacatcaacgacaacaccccccagttccagctggaggagctggagttcaagatgaacgagatcaccacccccggcaccagagtgagcctgcccttcggccaggacctggacgtgggcatgaacagcctgcagagctaccagctgagcagcaacccccacttcagcctggacgtgcagcagggcgccgacggcccccagcaccccgagatggtgctgcagagccccctggacagagaggaggaggccgtgcaccacctgatcctgaccgccagcgacggcggcgagcccgtgagaagcggcaccctgagaatctacatccaggtggtggacgccaacgacaacccccccgccttcacccaggcccagtaccacatcaacgtgcccgagaacgtgcccctgggcacccagctgctgatggtgaacgccaccgaccccgacgagggcgccaacggcgaggtgacctacagcttccacaacgtggaccacagagtggcccagatcttcagactggacagctacaccggcgagatcagcaacaaggagcccctggacttcgaggagtacaagatgtacagcatggaggtgcaggcccaggacggcgccggcctgatggccaaggtgaaggtgctgatcaaggtgctggacgtgaacgacaacgcccccgaggtgaccatcaccagcgtgaccaccgccgtgcccgagaacttcccccccggcaccatcatcgccctgatcagcgtgcacgaccaggacagcggcgacaacggctacaccacctgcttcatccccggcaacctgcccttcaagctggagaagctggtggacaactactacagactggtgaccgagagaaccctggacagagagctgatcagcggctacaacatcaccatcaccgccatcgaccagggcacccccgccctgagcaccgagacccacatcagcctgctggtgaccgacatcaacgacaacagccccgtgttccaccaggacagctacagcgcctacatccccgagaacaaccccagaggcgccagcatcttcagcgtgagagcccacgacctggacagcaacgagaacgcccagatcacctacagcctgatcgaggacaccatccagggcgcccccctgagcgcctacctgagcatcaacagcgacaccggcgtgctgtacgccctgagaagcttcgactacgagcagttcagagacatgcagctgaaggtgatggccagagacagcggcgacccccccctgagcagcaacgtgagcctgagcctgttcctgctggaccagaacgacaacgcccccgagatcctgtaccccgccctgcccaccgacggcagcaccggcgtggagctggcccccctgagcgccgagcccggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagaatcagcgacatcctggccgacctgggcagcctggagcccagcgccaagcccaacgacagcgacctgaccctgtacctggtggtggccgccgccgccgtgagctgcgtgttcctggccttcgtgatcgtgctgctggcccacagactgagaagatggcacaagagcagactgctgcaggccagcggcggcggcctggccagcatgcccggcagccacttcgtgggcgtggacggcgtgagagccttcctgcagacctacagccacgaggtgagcctgaccgccgacagcagaaagagccacctgatcttcccccagcccaactacgccgacaccctgatcagccaggagagctgcgagaagaagggcttcctgagcgccccccagagcctgctggaggacaagaaggagcccttcagccaggtgaacttctgcgacgagtgcatcagctacctggagaagaacaacagctag

SEQ ID NO: 95746 - DNA, 2796 bp, Artificial Sequence
  Description of Artificial Sequence: Synthetic coding sequence
atgaagatccagaagaagctgaccggctgcagcagactgatgctgctgtgcctgagcctggagctgctgctggaggccggcgccggcaacatccactacagcgtgcccgaggagaccgacaagggcagcttcgtgggcaacatcgccaaggacctgggcctgcagccccaggagctggccgacggcggcgtgagaatcgtgagcagaggcagaatgcccctgttcgccctgaaccccagaagcggcagcctgatcaccgccagaagaatcgacagagaggagctgtgcgcccagagcatgccctgcctggtgagcttcaacatcctggtggaggacaagatgaagctgttccccgtggaggtggagatcatcgacatcaacgacaacaccccccagttccagctggaggagctggagttcaagatgaacgagatcaccacccccggcaccagagtgagcctgcccttcggccaggacctggacgtgggcatgaacagcctgcagagctaccagctgagcagcaacccccacttcagcctggacgtgcagcagggcgccgacggcccccagcaccccgagatggtgctgcagagccccctggacagagaggaggaggccgtgcaccacctgatcctgaccgccagcgacggcggcgagcccgtgagaagcggcaccctgagaatctacatccaggtggtggacgccaacgacaacccccccgccttcacccaggcccagtaccacatcaacgtgcccgagaacgtgcccctgggcacccagctgctgatggtgaacgccaccgaccccgacgagggcgccaacggcgaggtgacctacagcttccacaacgtggaccacagagtggcccagatcttcagactggacagctacaccggcgagatcagcaacaaggagcccctggacttcgaggagtacaagatgtacagcatggaggtgcaggcccaggacggcgccggcctgatggccaaggtgaaggtgctgatcaaggtgctggacgtgaacgacaacgcccccgaggtgaccatcaccagcgtgaccaccgccgtgcccgagaacttcccccccggcaccatcatcgccctgatcagcgtgcacgaccaggacagcggcgacaacggctacaccacctgcttcatccccggcaacctgcccttcaagctggagaagctggtggacaactactacagactggtgaccgagagaaccctggacagagagctgatcagcggctacaacatcaccatcaccgccatcgaccagggcacccccgccctgagcaccgagacccacatcagcctgctggtgaccgacatcaacgacaacagccccgtgttccaccaggacagctacagcgcctacatccccgagaacaaccccagaggcgccagcatcttcagcgtgagagcccacgacctggacagcaacgagaacgcccagatcacctacagcctgatcgaggacaccatccagggcgcccccctgagcgcctacctgagcatcaacagcgacaccggcgtgctgtacgccctgagaagcttcgactacgagcagttcagagacatgcagctgaaggtgatggccagagacagcggcgacccccccctgagcagcaacgtgagcctgagcctgttcctgctggaccagaacgacaacgcccccgagatcctgtaccccgccctgcccaccgacggcagcaccggcgtggagctggcccccctgagcgccgagcccggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagaatcagcgacatcctggccgacctgggcagcctggagcccagcgccaagcccaacgacagcgacctgaccctgtacctggtggtggccgccgccgccgtgagctgcgtgttcctggccttcgtgatcgtgctgctggcccacagactgagaagatggcacaagagcagactgctgcaggccagcggcggcggcctggccagcatgcccggcagccacttcgtgggcgtggacggcgtgagagccttcctgcagacctacagccacgaggtgagcctgaccgccgacagcagaaagagccacctgatcttcccccagcccaactacgccgacaccctgatcagccaggagagctgcgagaagaagggcttcctgagcgccccccagagcctgctggaggacaagaaggagcccttcagccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95747 - DNA, 2811 bp, Artificial Sequence
  Description of Artificial Sequence: Synthetic coding sequence
atggccgcccagagaaacagaagcaaggagagcaaggactgcagcggcctggtgctgctgtgcctgttcttcggcatcccctgggaggccggcgccagacagatcagctacagcatccccgaggagctggagaagggcagcttcgtgggcaacatcagcaaggacctgggcctggcccccagagagctggccgagagaggcgtgagaatcgtgagcagaggcagaacccagctgttcagcctgaaccccagaagcggcagcctgatcaccgccggcagaatcgacagagaggagctgtgcgcccagagcgccagatgcgtggtgagcttcaacatcctggtggaggacagagtgaagctgttcggcatcgagatcgaggtgaccgacatcaacgacaacgcccccaagttccaggccgagaacctggacgtgaagatcaacgagaacgtggccgccggcatgagattccccctgcccgaggccatcgaccccgacgtgggcgtgaacagcctgcagagctaccagctgagccccaacaagcacttcagcctgagagtgcagagcagagccaacggcgtgaagtaccccgagctggtgctggagcacagcctggacagagaggaggaggccatccaccacctggtgctgaccgccagcgacggcggcgaccccctgagaagcggcaccgtgctggtgagcgtgaccgtgttcgacgccaacgacaacgcccccgtgttcaccctgcccgagtacagagtgagcgtgcccgagaacctgcccgtgggcacccagctgctgaccgtgaccgccaccgacagagacgagggcgccaacggcgaggtgacctacagcttcagaaagctgcccgacacccagctgctgaagttccagctgaacaagtacaccggcgagatcaagatcagcgagaacctggactacgaggagaccggcttctacgagatcgagatccaggccgaggacggcggcgcctacctggccaccgccaaggtgctgatcaccgtggaggacgtgaacgacaacagccccgagctgaccatcaccagcctgttcagccccgtgaccgaggacagccccctgggcaccgtggtggccctgctgaacgtgcacgacctggacagcgagcagaacggccaggtgacctgcagcatcctggcctacctgcccttcaagctggagaagagcatcgacagctactacagactggtgatccacagagccctggacagagagcaggtgagcagctacaacatcaccgtgaccgccaccgacggcggcagcccccccctgagcaccgaggcccacttcatgctgcaggtggccgacatcaacgacaacccccccaccttcagccaggtgagctacttcacctacatccccgagaacaacgccagaggcgccagcatcttcagcgtgaccgccctggaccccgacagcaaggagaacgcccagatcatctacagcctggccgaggacaccatccagggcgtgcccctgagcagctacatcagcatcaacagcgacaccggcgtgctgtacgccctgagaagcttcgactacgagcagttccacgagctgcagatgcaggtgaccgccagcgacagcggcgacccccccctgagcagcaacgtgagcctgagcctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacagagacagcggccagaacgcctggctgagctacagactgctgaaggccagcgagcccggcctgttcgccgtgggcgagcacaccggcgaggtgagaaccgccagagccctgctggacagagacgccctgaagcagagcctggtggtggccgtgcaggaccacggccagccccccctgagcgccaccgtgaccctgaccgtggccgtggccgacagcatcccccaggtgctggccgacctgggcagcttcgagagccccgccaacagcgagaccagcgacctgaccctgtacctggtggtggccgtggccgccgtgagctgcgtgttcctggccttcgtgatcgtgctgctggcccacagactgagaagatggcacaagagcagactgctgcaggccagcggcggcggcctgaccggcgtgagcggcagccacttcgtgggcgtggacggcgtgagagccttcctgcagacctacagccacgaggtgagcctgaccgccgacagcagaaagagccacctgatcttcccccagcccaactacgccgacaccctgatcagccaggagagctgcgagaagaacgaccccctgagcctgctggacgacagcaagttccccatcgaggacacccccctggtgccccaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95748 - DNA, 2808 bp, Artificial Sequence
  Description of Artificial Sequence: Synthetic coding sequence
atggccaacagactgcagagaggcgacagaagcagactgctgctgctgctgtgcatcttcctgggcaccctgagaggcttcagagccagacagatcagatacagcgtgcccgaggagaccgagaagggcagcttcgtgggcaacatcagcaaggacctgggcctggagcccagagagctggccaagagaggcgtgagaatcgtgagcagaggcaagacccagctgttcgccgtgaaccccagaagcggcagcctgatcaccgccggcagaatcgacagagaggagctgtgcgagaccgtgagcagctgcttcctgaacatggagctgctggtggaggacaccctgaagatctacggcgtggaggtggagatcatcgacatcaacgacaacgcccccagcttccaggaggacgaggtggagatcaaggtgagcgagcacgccatccccggcgccagattcgccctgcccaacgccagagaccccgacgtgggcgtgaacagcctgcagagctaccagctgagccccaacaactacttcagcctgcagctgagaggcagaaccgacggcgccaagaaccccgagctggtgctggagggcagcctggacagagagaaggaggccgcccacctgctgctgctgaccgccctggacggcggcgaccccatcagaaagggcgccgtgcccatcagagtggtggtgctggacgtgaacgaccacatccccatgttcacccagagcgtgtacagagtgagcgtgcccgagaacatcagcagcggcaccagagtgctgatggtgaacgccaccgaccccgacgagggcatcaacggcgaggtgatgtacagcttcagaaacatggagagcaaggccagcgagatcttccagctggacagccagaccggcgaggtgcaggtgagaggcagcctggacttcgagaagtacagattctacgagatggagatccagggccaggacggcggcggcctgttcaccaccaccaccatgctgatcaccgtggtggacgtgaacgacaacgcccccgagatcaccatcaccagcagcatcaacagcatcctggagaacagcccccccggcaccgtgatcgccctgctgaacgtgcaggaccaggacagcggcgagaacggccaggtgagctgcttcatccccaaccacctgcccttcaagctggagaagacctacggcaactactacaagctgatcaccagcagagtgctggacagagagctggtgcagagctacaacatcaccctgaccgccaccgaccagggcagcccccccctgagcgccgagacccacgtgtggctgaacgtggccgacgacaacgacaacccccccgtgttcccccacagcagctacagcgcctacatccccgagaacaaccccagaggcgccagcatcttcagcgtgaccgccctggaccccgacagcaagcagaacgccctggtgacctacagcctgaccgacgacaccgtgcagggcgtgcccctgagcagctacgtgagcatcaacagcaacaccggcgtgctgtacgccctgcagagcttcgactacgagcagttcagagacctggagctgagagtgatcgccagagacagcggcgacccccccctgagcagcaacgtgagcctgagcctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacaaggacagcggccagaacgcctggctgagctacagactgctgaaggccagcgagcccggcctgttcgccgtgggcgagcacaccggcgaggtgagaaccgccagagccctgctggacagagacgccctgaagcagagcctggtggtggccgtgcaggaccacggccagccccccctgagcgccaccgtgaccctgaccgtggccgtggccgacagcatccccgaggtgctggccgacctgggcagcctggagagcctggccaacagcgagaccagcgacctgagcctgtacctggtggtggccgtggccgccgtgagctgcatcttcctggtgttcgtgatcgtgctgctggccctgagactgtggagatggcacaagagcagactgctgcaggccagcgagggcggcctggccggcatgcccaccagccacttcgtgggcgtggacggcgtgcaggccttcctgcagacctacagccacgaggtgagcctgatcgccgacagccagaagagccacctgatcttcccccagcccaactacggcgacaccctgatcagccaggagagctgcgagaagagcgagcccctgctgatcgccgaggacagcgccatcatcctgggcaagtgcgaccccaccagcaaccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95749 - DNA, 2253 bp, Artificial Sequence
  Description of Artificial Sequence: Synthetic coding sequence
atggccaacagactgcagagaggcgacagaagcagactgctgctgctgctgtgcatcttcctgggcaccctgagaggcttcagagccagacagatcagatacagcgtgcccgaggagaccgagaagggcagcttcgtgggcaacatcagcaaggacctgggcctggagcccagagagctggccaagagaggcgtgagaatcgtgagcagaggcaagacccagctgttcgccgtgaaccccagaagcggcagcctgatcaccgccggcagaatcgacagagaggagctgtgcgagaccgtgagcagctgcttcctgaacatggagctgctggtggaggacaccctgaagatctacggcgtggaggtggagatcatcgacatcaacgacaacgcccccagcttccaggaggacgaggtggagatcaaggtgagcgagcacgccatccccggcgccagattcgccctgcccaacgccagagaccccgacgtgggcgtgaacagcctgcagagctaccagctgagccccaacaactacttcagcctgcagctgagaggcagaaccgacggcgccaagaaccccgagctggtgctggagggcagcctggacagagagaaggaggccgcccacctgctgctgctgaccgccctggacggcggcgaccccatcagaaagggcgccgtgcccatcagagtggtggtgctggacgtgaacgaccacatccccatgttcacccagagcgtgtacagagtgagcgtgcccgagaacatcagcagcggcaccagagtgctgatggtgaacgccaccgaccccgacgagggcatcaacggcgaggtgatgtacagcttcagaaacatggagagcaaggccagcgagatcttccagctggacagccagaccggcgaggtgcaggtgagaggcagcctggacttcgagaagtacagattctacgagatggagatccagggccaggacggcggcggcctgttcaccaccaccaccatgctgatcaccgtggtggacgtgaacgacaacgcccccgagatcaccatcaccagcagcatcaacagcatcctggagaacagcccccccggcaccgtgatcgccctgctgaacgtgcaggaccaggacagcggcgagaacggccaggtgagctgcttcatccccaaccacctgcccttcaagctggagaagacctacggcaactactacaagctgatcaccagcagagtgctggacagagagctggtgcagagctacaacatcaccctgaccgccaccgaccagggcagcccccccctgagcgccgagacccacgtgtggctgaacgtggccgacgacaacgacaacccccccgtgttcccccacagcagctacagcgcctacatccccgagaacaaccccagaggcgccagcatcttcagcgtgaccgccctggaccccgacagcaagcagaacgccctggtgacctacagcctgaccgacgacaccgtgcagggcgtgcccctgagcagctacgtgagcatcaacagcaacaccggcgtgctgtacgccctgcagagcttcgactacgagcagttcagagacctggagctgagagtgatcgccagagacagcggcgacccccccctgagcagcaacgtgagcctgagcctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacaaggacagcggccagaacgcctggctgagctacagactgctgaaggccagcgagcccggcctgttcgccgtgggcgagcacaccggcgagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95750 - DNA, 2799 bp, Artificial Sequence
  Description of Artificial Sequence: Synthetic coding sequence
atgatccccgccagactgcacagagactacaagggcctggtgctgctgggcatcctgctgggcaccctgtgggagaccggctgcacccagatcagatacagcgtgcccgaggagctggagaagggcagcagagtgggcgacatcagcagagacctgggcctggagcccagagagctggccgagagaggcgtgagaatcatccccagaggcagaacccagctgttcgccctgaaccccagaagcggcagcctggtgaccgccggcagaatcgacagagaggagctgtgcatgggcgccatcaagtgccagctgaacctggacatcctgatggaggacaaggtgaagatctacggcgtggaggtggaggtgagagacatcaacgacaacgccccctacttcagagagagcgagctggagatcaagatcagcgagaacgccgccaccgagatgagattccccctgccccacgcctgggaccccgacatcggcaagaacagcctgcagagctacgagctgagccccaacacccacttcagcctgatcgtgcagaacggcgccgacggcagcaagtaccccgagctggtgctgaagagagccctggacagagaggagaaggccgcccaccacctggtgctgaccgccagcgacggcggcgaccccgtgagaaccggcaccgccagaatcagagtgatggtgctggacgccaacgacaacgcccccgccttcgcccagcccgagtacagagccagcgtgcccgagaacctggccctgggcacccagctgctggtggtgaacgccaccgaccccgacgagggcgtgaacgccgaggtgagatacagcttcagatacgtggacgacaaggccgcccaggtgttcaagctggactgcaacagcggcaccatcagcaccatcggcgagctggaccacgaggagagcggcttctaccagatggaggtgcaggccatggacaacgccggctacagcgccagagccaaggtgctgatcaccgtgctggacgtgaacgacaacgcccccgaggtggtgctgaccagcctggccagcagcgtgcccgagaacagccccagaggcaccctgatcgccctgctgaacgtgaacgaccaggacagcgaggagaacggccaggtgatctgcttcatccagggcaacctgcccttcaagctggagaagagctacggcaactactacagcctggtgaccgacatcgtgctggacagagagcaggtgcccagctacaacatcaccgtgaccgccaccgacagaggcaccccccccctgagcaccgagacccacatcagcctgaacgtggccgacaccaacgacaacccccccgtgttcccccaggccagctacagcgcctacatccccgagaacaaccccagaggcgtgagcctggtgagcgtgaccgcccacgaccccgactgcgaggagaacgcccagatcacctacagcctggccgagaacaccatccagggcgccagcctgagcagctacgtgagcatcaacagcgacaccggcgtgctgtacgccctgagcagcttcgactacgagcagttcagagacctgcaggtgaaggtgatggccagagacaacggccacccccccctgagcagcaacgtgagcctgagcctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagcatcccccaggtgctggccgacctgggcagcctggagagccccgccaacagcgagaccagcgacctgaccctgtacctggtggtggccgtggccgccgtgagctgcgtgttcctggccttcgtgatcctgctgctggccctgagactgagaagatggcacaagagcagactgctgcaggccagcggcggcggcctgaccggcgcccccgccagccacttcgtgggcgtggacggcgtgcaggccttcctgcagacctacagccacgaggtgagcctgaccaccgacagcagaaagagccacctgatcttcccccagcccaactacgccgacatgctggtgagccaggagagcttcgagaagagcgagcccctgctgctgagcggcgacagcgtgttcagcaaggacagccacggcctgatcgagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95751 - DNA, 2799 bp, Artificial Sequence
  Description of Artificial Sequence: Synthetic coding sequence
atggccgccctgcagaagctgccccactgcagaaagctggtgctgctgtgcttcctgctggccaccctgtgggaggccagagccggccagatcagatacagcgtgagagaggagatcgacagaggcagcttcgtgggcaacatcgccaaggacctgggcctggagcccctggccctggccgagcagggcgtgagaatcgtgagcagaggcagaagccagctgttcgccctgaaccccagaagcggcagcctggtgaccgccaacagaatcgacagagaggagctgtgcgcccagagcgccccctgcctgctgaacttcaacatcctgctggaggacaagctgaccatctacagcgtggaggtggagatcaccgacatcaacgacaacgcccccagattcggcgtggaggagctggagctgaagatcagcgagaccaccacccccggcttcagaatccccctgaagaacgcccacgacgccgacgtgggcgagaacgccctgcagaagtacgccctgaaccccaacgaccacttcagcctggacgtgagaagaggcgccgacggcaacaagtaccccgagctggtgctggagagaagcctggacagagaggaggaggccgtgcaccacctggtgctggtggccagcgacggcggcgaccccgtgctgagcggcaccagcagaatctgcgtgaaggtgctggacgccaacgacaacgcccccgtgttcacccagcccgagtacagaatcagcatccccgagaacaccctggtgggcaccagaatcctgaccgtgaccgccaccgacgccgacgagggctactacgcccaggtggtgtacttcctggagaagagccccggcgagaccagcgaggtgttcgagctgaagagcaccagcggcgagctgaccatcatcaaggacctggactacgaggacgccaccttccacgagatcgacatcgaggcccaggacggccccggcctgctgaccagagccaaggtgatcgtgaccgtgctggacgtgaacgacaacgcccccgagttctacatgaccagcgccaccagcagcgtgagcgaggacagcctgcccggcaccatcatcggcctgttcaacgtgcacgacagagacagcggccagaacgccttcaccacctgcagcctgcccgaggacctgcccttcaagctggagaagagcgtggacaactactacagactggtgaccaccagagccctggacagagagcagttcagcttctacaacatcaccctgaccgccaaggacggcggcaaccccagcctgagcaccgacgcccacatcctgctgcaggtggccgacatcaacgacaacgcccccgccttcagcagaaccagctacagcacctacatccccgagaacaaccccagaggcgccagcgtgttcagcgtgaccgcccacgaccccgacagcaacgacaacgcccacgtgacctacagcttcgccgaggacaccgtgcagggcgcccccctgagcagctacatcagcatcaacagcgacaccggcgtgctgtacgccctgagaagcttcgactacgagcagctgagagacctgcaggtgtgggtgatcgccagagacagcggcaacccccccctgagcagcaacgtgagcctgagcctgttcgtgctggaccagaacgacaacgcccccgagatcctgtaccccgccttccccaccgacggcagcaccggcgtggagctggcccccagaagcgccgagcccggctacctggtgaccaaggtggtggccgtggacagagacagcggccagaacgcctggctgagctaccacctgctgaaggccagcgagcccggcctgttcagcgtgggcctgcacaccggcgaggtgagaaccgccagagccctgctggacagagacgccctgaagcagagcctggtggtggccatccaggaccacggccagccccccctgagcgccaccgtgaccctgaccgtggccgtggccgacagaatccccgacatcctggccgacctgggcagcctggagcccagcgccatccccaacgacagcgacctgaccctgtacctggtggtggccgtggccgccgtgagctgcgtgttcctggccttcgtgatcgtgctgctggcccacagactgagaagatggcacaagagcagactgctgcaggccagcggcggcagcctgaccggcatgcagagcagccacttcgtgggcgtggacggcgtgagagccttcctgcagacctacagccacgaggtgagcctgaccgccgacagcagaaagagccacctgatcttcccccagcccaactacgccgacaccctgatcagccaggagagctgcgagaagaaggacttcctgagcgccccccagagcctgctggaggaggagagagaggagaccttcagccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95752 - DNA, 2799 bp, Artificial Sequence
  Description of Artificial Sequence: Synthetic coding sequence
atgaccaactgcctgagcttcagaaacggcagaggcctggccctgctgtgcgccctgctgggcaccctgtgcgagaccggcagcggccagatcagatacagcgtgagcgaggagctggacaagggcagcttcgtgggcaacatcgccaacgacctgggcctggagcccagagagctggccgagagaggcgtgagaatcgtgagcagaggcagaacccagctgttcagcctgaacccccagagcggcagcctggtgaccgccgagagaatcgacagagaggagctgtgcgcccagatccccctgtgcctggtgaagatcaacatcctggtggaggacaagctgaagatcttcgaggtggagatcgagatcaaggacatcaacgacaacgcccccaacttccccaccgaggagctggagatcaagatcggcgagctgaccgtgcccggcaccagattccccatcaagaccgccttcgaccccgacgtgggcatcaacagcctgcagaactacaagctgagccccaacgactacttcagcctggccgtgaacagcgtgagcgagggcgccaagtaccccgagctggtgctggagagagccctggacagagagaagaaggagatccaccagctggtgctggtggccagcgacggcggcgaccccgtgcacagcggcaacctgcacatccaggtgatcgtgctggacgccaacgacaacccccccatgttcacccagcccgagtacagagtgagcgtgtgggagaacgtgcccgtgggcaccagactgctgaccgtgaacgccaccgaccccgacgagggcttcaacgcccaggtgagctacatcctggacaagatgcccggcaagatcgccgagatcttccacctgaacagcgtgagcggcgaggtgagcatcctgaagagcctggactacgaggacgccatgttctacgagatcaagatcgaggcccaggacggccccggcctgctgagcagagccaagatcctggtgaccgtgctggacgtgaacgacaacgcccccgagatcaccatcaccagcctgaccagcagcgtgcccgaggagggcaccgtgggcagagagatcgccctgatcgacgtgcacgacagagacagcggccagaacggccaggtggaggtgttcgtgctgggcaacctgcccttcaagctggagaagagcatcgaccagtactacagactggtgaccgccaccagcctggacagagagcagatcagcgagtacaacatcagcctgagagccagcgacggcggcagcccccccctgagcaccgagacccacatcaccctgcacgtgatcgacatcaacgacaacccccccaccttcccccacctgagctacagcgcctacatccccgagaacaaccccagaggcgccagcatcttcagcgtgaccgcccaggaccccgacagcaacaacaacgccagaatcacctacgccctgaccgaggacaccctgcagggcgcccccctgagcagcttcgtgagcatcaacagcaacaccggcgtgctgtacgccctgagaagcttcgactacgagcagttcagagacctgaagctgctggtgaccgccagcgacagcggcaacccccccctgagcagcaacgtgagcctgaacctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagaatccccgacatcctggccgacctgggcagcctggagcccagcgccaagcccaacgacagcgacctgaccctgtacctggtggtggccgtggccgccgtgagctgcgtgttcctggccttcgtgatcgtgctgctggccctgagactgagaagatggcacaagagcagactgctgcaggccagcggcggcggcctggccagcacccccggcagccacttcgtgggcgccgacggcgtgagagccttcctgcagacctacagccacgaggtgagcctgaccgccgacagcagaaagagccacctgatcttcccccagcccaactacgccgacaccctgatcagccaggagagctgcgagaagagcgagcccctgctgatcacccaggacctgctggagatgaagggcgacagcaacctgctgcagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95753 - DNA, 2796 bp, Artificial Sequence
  Description of Artificial Sequence: Synthetic coding sequence
atggccagcccccccagaggctggggctgcggcgagctgctgctgcccttcatgctgctgggcaccctgtgcgagcccggcagcggccagatcagatacagcatgcccgaggagctggacaagggcagcttcgtgggcaacatcgccaaggacctgggcctggagccccaggagctggccgagagaggcgtgagaatcgtgagcagaggcagaacccagctgttcgccctgaaccccagaagcggcagcctggtgaccgccggcagaatcgacagagaggagctgtgcgcccagagccccctgtgcgtggtgaacttcaacatcctggtggagaacaagatgaagatctacggcgtggaggtggagatcatcgacatcaacgacaacttccccagattcagagacgaggagctgaaggtgaaggtgaacgagaacgccgccgccggcaccagactggtgctgcccttcgccagagacgccgacgtgggcgtgaacagcctgagaagctaccagctgagcagcaacctgcacttcagcctggacgtggtgagcggcaccgacggccagaagtaccccgagctggtgctggagcagcccctggacagagagaaggagaccgtgcacgacctgctgctgaccgccctggacggcggcgaccccgtgctgagcggcaccacccacatcagagtgaccgtgctggacgccaacgacaacgcccccctgttcacccccagcgagtacagcgtgagcgtgcccgagaacatccccgtgggcaccagactgctgatgctgaccgccaccgaccccgacgagggcatcaacggcaagctgacctacagcttcagaaacgaggaggagaagatcagcgagaccttccagctggacagcaacctgggcgagatcagcaccctgcagagcctggactacgaggagagcagattctacctgatggaggtggtggcccaggacggcggcgccctggtggccagcgccaaggtggtggtgaccgtgcaggacgtgaacgacaacgcccccgaggtgatcctgaccagcctgaccagcagcatcagcgaggactgcctgcccggcaccgtgatcgccctgttcagcgtgcacgacggcgacagcggcgagaacggcgagatcgcctgcagcatccccagaaacctgcccttcaagctggagaagagcgtggacaactactaccacctgctgaccaccagagacctggacagagaggagaccagcgactacaacatcaccctgaccgtgatggaccacggcaccccccccctgagcaccgagagccacatccccctgaaggtggccgacgtgaacgacaacccccccaacttcccccaggccagctacagcaccagcgtgaccgagaacaaccccagaggcgtgagcatcttcagcgtgaccgcccacgaccccgacagcggcgacaacgccagagtgacctacagcctggccgaggacaccttccagggcgcccccctgagcagctacgtgagcatcaacagcgacaccggcgtgctgtacgccctgagaagcttcgactacgagcagctgagagacctgcagctgtgggtgaccgccagcgacagcggcaacccccccctgagcagcaacgtgagcctgagcctgttcgtgctggaccagaacgacaacacccccgagatcctgtaccccgccctgcccaccgacggcagcaccggcgtggagctggcccccagaagcgccgagcccggctacctggtgaccaaggtggtggccgtggacaaggacagcggccagaacgcctggctgagctacagactgctgaaggccagcgagcccggcctgttcgccgtgggcctgcacaccggcgaggtgagaaccgccagagccctgctggacagagacgccctgaagcagagcctggtggtggccgtggaggaccacggccagccccccctgagcgccaccttcaccgtgaccgtggccgtggccgacagaatccccgacatcctggccgacctgggcagcatcaagacccccatcgaccccgaggacctggacctgaccctgtacctggtggtggccgtggccgccgtgagctgcgtgttcctggccttcgtgatcgtgctgctggtgctgagactgagaagatggcacaagagcagactgctgcaggccgagggcagcagactggccggcgtgcccgccagccacttcgtgggcgtggacggcgtgagagccttcctgcagacctacagccacgaggtgagcctgaccgccgacagcagaaagagccacctgatcttcccccagcccaactacgccgacaccctgctgagcgaggagagctgcgagaagagcgagcccctgctgatgagcgacaaggtggacgccaacaaggaggagagaagagtgcagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95754 - DNA, 2799 bp, Artificial Sequence
  Description of Artificial Sequence: Synthetic coding sequence
atggcccccccccagagacacccccagagaagcgagcaggtgctgctgctgaccctgctgggcaccctgtggggcgccgccgccgcccagatcagatacagcatccccgaggagctggagaagggcagcttcgtgggcaacatcgtgaaggacctgggcctggagccccaggagctggccgagcacggcgtgagaatcgtgagcagaggcagaatgcagctgttcagcctgaaccccagaaacggcagcctggtgaccgccggcagaatcgacagagaggagctgtgcgcccagagccccagatgcctggtgagcttcaacatcctggtggaggacaagctgaacctgtaccccgtggaggtggagatcgtggacatcaacgacaacacccccagattcctgaaggaggagctggaggtgaagatcctggagaacgccgcccccagcagcagattccccctgatggaggtgtacgaccccgacgtgggcatgaacagcctgcagggcttcaagctgagcggcaacagccacttcagcgtggacgtgcagagcgaggcccacggccccaagtaccccgagctggtgctggagggcaccctggacagagagggcgaggccgtgtacagactggtgctgaccgccatggacggcggcgaccccgtgagaagcagcgtggcccagatcctggtgaccgtgctggacgtgaacgacaacacccccatgttcacccagcccgtgtacagagtgagcgtgcccgagaacctgcccgtgggcacccccgtgctggccgtgaccgccaccgaccaggacgagggcgtgcacggcgaggtgacctacagcttcgtgaagatcaccgagaagatcagccagatcttctgcctgaacgtgctgaccggcgagatcagcaccagcgccaacctggactacgaggacagcagcttctacgagctgggcgtggaggccagagacggccccggcctgagagacagagccaaggtgctgatcaccatcctggacgtgaacgacaacgtgcccgaggtggtggtgaccagcggcagcagaaccatcgccgagagcgccccccccggcaccgtgatcgccctgttccaggtgttcgacagagacagcggcctgaacggcctggtgacctgcagcatccccagaagcctgcccttcgagctggagaagagcgtgggcaactactacagactggtgaccaacgccgccctggacagagaggaggtgttcctgtacaacatcaccgtgaccgccaccgacaagggcaccccccccctgagcaccgagaccatcatcagcctgaacgtggccgacaccaacgacaacccccccaccttcccccacagcagctacagcgtgtacgtgctggagaacaaccccagaggcgccagcatcttcagcgtgaacgccctggaccccgacgtggaccagaacgcccaggtgagctacagcctggccgaggacaccctgcagggcgcccccctgagcagctacgtgagcatcaacagcgacaccggcatcctgtacgccctgagaagcttcgactacgagcagctgagagacctgcagctgtgggtgaccgccagcgacagcggcgacccccccctgagcagcaacgtgagcctgagcctgttcgtgctggaccagaacgacaacgcccccgagatcctgtaccccgccctgcccaccgacggcagcaccggcgtggagctggcccccagaagcgccgagcccggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagaatccccgacatcctggccgacctgggcagcctggagcccagcgccaagcccaacgacagcgacctgaccctgtacctggtggtggccgtggccgccgtgagctgcgtgttcctggccttcgtgatcgtgctgctggccctgagactgcagagatggcacaagagcagactgctgcaggccagcggcggcggcctggccagcatgcccggcagccacttcgtgggcgtggagggcgtgagagccttcctgcagacctacagccacgaggtgagcctgaccgccgacagcagaaagagccacctgatcttcccccagcccaactacgccgacaccctgatcaaccaggagagctacgagaagagcgagcccctgctgatcacccaggacctgctggagaccaagggcgagcccagacagctgcagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95755 - DNA, 2799 bp, Artificial Sequence
  Description of Artificial Sequence: Synthetic coding sequence
atggccgcccagcccagaggcggcgactacagaggcttcttcctgctgagcatcctgctgggcaccccctgggaggcctgggccggcagaatcctgtacagcgtgagcgaggagaccgacaagggcagcttcgtgggcgacatcgccaaggacctgggcctggagcccagagagctggccgagagaggcgtgagaatcatcagcagaggcagaacccagctgttcgccctgaaccagagaagcggcagcctggtgaccgccggcagaatcgacagagaggagatctgcgcccagagcgccagatgcctggtgaacttcaacatcctgatggaggacaagatgaacctgtaccccatcgacgtggagatcatcgacatcaacgacaacgtgcccagattcctgaccgaggagatcaacgtgaagatcatggagaacaccgcccccggcgtgagattccccctgagcgaggccggcgaccccgacgtgggcaccaacagcctgcagagctaccagctgagccccaacagacacttcagcctggccgtgcagagcggcgacgacgagaccaagtaccccgagctggtgctggagagagtgctggacagagaggaggagagagtgcaccacctggtgctgaccgccagcgacggcggcgacccccccagaagcagcaccgcccacatccaggtgaccgtggtggacgtgaacgaccacacccccgtgttcagcctgccccagtaccaggtgaccgtgcccgagaacgtgcccgtgggcaccagactgctgaccgtgcacgccatcgacctggacgagggcgtgaacggcgaggtgacctacagcttcagaaagatcacccccaagctgcccaagatgttccacctgaacagcctgaccggcgagatcagcaccctggagggcctggactacgaggagaccgccttctacgagatggaggtgcaggcccaggacggccccggcagcctgaccaaggccaaggtgctgatcaccgtgctggacgtgaacgacaacgcccccgaggtgaccatgaccagcctgagcagcagcatccccgaggacacccccctgggcaccgtgatcgccctgttctacctgcaggacagagacagcggcaagaacggcgaggtgacctgcaccatccccgagaacctgcccttcaagctggagaagagcatcgacaactactacagactggtgaccaccaagaacctggacagagagaccctgagcctgtacaacatcaccctgaaggccaccgacggcggcaccccccccctgagcagagagacccacatcttcatgcaggtggccgacaccaacgacaacccccccaccttcccccacagcagctacagcgtgtacatcgccgagaacaaccccagaggcgccagcatcttcctggtgaccgcccaggaccacgacagcgaggacaacgcccagatcacctacagcctggccgaggacaccatccagggcgcccccgtgagcagctacgtgagcatcaacagcgacaccggcgtgctgtacgccctgcagagcttcgactacgagcagctgagagagctgcagctgagagtgaccgcccacgacagcggcgacccccccctgagcagcaacatgagcctgagcctgttcgtgctggaccagaacgacaacccccccgagatcctgtaccccgccctgcccaccgacggcagcaccggcatggagctggcccccagaagcgccgagcccggctacctggtgaccaaggtggtggccgtggacaaggacagcggccagaacgcctggctgagctacctgctgctgaaggccagcgagcccggcctgttcgccgtgggcctgtacaccggcgaggtgagaaccgccagagccctgctggacagagacgccctgaagcagagcctggtggtggccgtgcaggaccacggccagccccccctgagcgccaccgtgaccctgaccgtggccgtggccgacagcatccccgaggtgctggccgacctgggcagcctggagcccagcgacggcccctacaactacgacctgaccctgtacctggtggtggccgtggccaccgtgagctgcgtgttcctggccttcgtgctggtgctgctggccctgagactgagaagatggcacaagagcagactgctgcaggccagcgagggcggcctggccaacgtgcccaccagccacttcgtgggcatggacggcgtgcaggccttcctgcagacctacagccacgaggtgagcctgaccgccgacagcagaaagagccacctgatcttcccccagcccaactacgtggacatgctgatcagccaggagagctgcgagaagaacgacagcctgctgaccagcgtggacttccaggagtgcaaggagaacctgcccagcatccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95756 - DNA, 2799 bp, Artificial Sequence
  Description of Artificial Sequence: Synthetic coding sequence
atggccgccccccagagcagacccagaagaggcgagctgatcctgctgtgcgccctgctgggcaccctgtgggagatcggcagaggccagatcagatacagcgtgcccgaggagaccgacaagggcagcttcgtgggcaacatcagcaaggacctgggcctggaccccagaaagctggccaagcacggcgtgagaatcgtgagcagaggcagaacccagctgttcgccctgaaccccagaagcggcagcctgatcaccgccggcagaatcgacagagaggagctgtgcgcccagagccccagatgcctgatcaacatcaacaccctggtggaggacaagggcaagctgttcggcgtggagatcgagatcatcgacatcaacgacaacaaccccaagttccaggtggaggacctggaggtgaagatcaacgagatcgccgtgcccggcgccagataccccctgcccgaggccgtggaccccgacgtgggcgtgaacagcctgcagagctaccagctgagccccaaccaccacttcagcctggacgtgcagaccggcgacaacggcgccatcaaccccgagctggtgctggagagagccctggacagagaggaggaggccgcccaccacctggtgctgaccgccagcgacggcggcaagccccccagaagcagcaccgtgagaatccacgtgaccgtgctggacaccaacgacaacgcccccgtgttcccccaccccatctacagagtgaaggtgctggagaacatgccccccggcaccagactgctgaccgtgaccgccagcgaccccgacgagggcatcaacggcaaggtggcctacaagttcagaaagatcaacgagaagcagacccccctgttccagctgaacgagaacaccggcgagatcagcatcgccaagagcctggactacgaggagtgcagcttctacgagatggagatccaggccgaggacgtgggcgccctgctgggcagaaccaagctgctgatcagcgtggaggacgtgaacgacaacagacccgaggtgatcatcaccagcctgttcagccccgtgctggagaacagcctgcccggcaccgtgatcgccttcctgagcgtgcacgaccaggacagcggcaagaacggccaggtggtgtgctacaccagagacaacctgcccttcaagctggagaagagcatcggcaactactacagactggtgaccagaaagtacctggacagagagaacgtgagcatctacaacatcaccgtgatggccagcgacctgggcaccccccccctgagcaccgagacccagatcgccctgcacgtggccgacatcaacgacaacccccccaccttcccccacgccagctacagcgcctacatcctggagaacaacctgagaggcgccagcatcttcagcctgaccgcccacgaccccgacagccaggagaacgcccaggtgacctacagcgtgaccgaggacaccctgcagggcgcccccctgagcagctacatcagcatcaacagcgacaccggcgtgctgtacgccctgcagagcttcgactacgagcagatcagagacctgcagctgctggtgaccgccagcgacagcggcgacccccccctgagcagcaacatgagcctgagcctgttcgtgctggaccagaacgacaacgcccccgagatcctgtaccccgccctgcccaccgacggcagcaccggcgtggagctggcccccagaagcgccgagagaggctacctggtgaccaaggtggtggccgtggacagagacagcggccagaacgcctggctgagctacagactgctgaaggccagcgagcccggcctgttcagcgtgggcctgcacaccggcgaggtgagaaccgccagagccctgctggacagagacgccctgaagcagagcctggtggtggccgtgcaggaccacggccagccccccctgagcgccaccgtgaccctgaccgtggccgtggccgacagcatccccgaggtgctgaccgagctgggcagcctgaagcccagcgtggaccccaacgacagcagcctgaccctgtacctggtggtggccgtggccgccatcagctgcgtgttcctggccttcgtggccgtgctgctgggcctgagactgagaagatggcacaagagcagactgctgcaggacagcggcggcagactggtgggcgtgcccgccagccacttcgtgggcgtggaggaggtgcaggccttcctgcagacctacagccaggaggtgagcctgaccgccgacagcagaaagagccacctgatcttcccccagcccaactacgccgacatgctgatcagccaggagggctgcgagaagaacgacagcctgctgaccagcgtggacttccacgagtacaagaacgaggccgaccacggccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95757 - DNA, 2784 bp, Artificial Sequence
  Description of Artificial Sequence: Synthetic coding sequence
atgcagagagccagagaggccgagatgatgaagagccaggtgctgttccccttcctgctgagcctgttctgcggcgccatcagccagcagatcagatacaccatccccgaggagctggccaacggcagcagagtgggcaagctggccaaggacctgggcctgagcgtgagagagctgcccaccagaaagctgagagtgagcgccgaggactacttcaacgtgagcctggagagcggcgacctgctggtgaacggcagaatcgacagagagaagatctgcggcagaaagctggagtgcgccctggagttcgagaccgtggccgagaaccccatgaacgtgttccacgtggtggtggtgatccaggacatcaacgacaacgcccccagattcgtggccaagggcatcgacctggagatctgcgagagcgccctgcccggcgtgaagttcagcctggacagcgcccaggacgccgacgtggagggcaacagcctgaagctgtacaccatcaaccccaaccagtacttcagcctgagcaccaaggagagccccgacggcagcaagtaccccgtgctgctgctggagaagcccctggacagagagcaccagagcagccacagactgatcctgaccgccatggacggcggcgacccccccctgagcggcaccacccacatctggatcagagtgaccgacgccaacgacaacgcccccgtgttcagccaggaggtgtacagagtgagcctgcaggagaacgtgccctggggcaccagcgtgctgagagtgatggccaccgaccaggacgagggcatcaacgccgagatcacctacgccttcctgaacagccccatcagcaccagcctgttcaacctgaaccccaacaccggcgacatcaccaccaacggcaccctggacttcgaggagaccagcagatacgtgctgagcgtggaggccaaggacggcggcgtgcacaccgcccactgcaacgtgcagatcgagatcgtggacgagaacgacaacgcccccgaggtgaccttcatgagcttcagcaaccagatccccgaggacagcgacctgggcaccgtgatcgccctgatcaaggtgagagacaaggacagcggccagaacggcatggtgacctgctacacccaggaggaggtgcccttcaagctggagagcaccagcaagaactactacaagctggtgatcgccggcgccctgaacagagagcagaccgccgactacaacgtgaccatcatcgccaccgacaagggcaagcccgccctgagcagcagaaccagcatcaccctgcacatcagcgacatcaacgacaacgcccccgtgttccaccaggccagctacgtggtgcacgtgagcgagaacaacccccccggcgccagcatcgcccaggtgagcgccagcgaccccgacctgggccccaacggcagagtgagctacagcatcctggccagcgacctggagcccagagagctgctgagctacgtgagcgtgagcccccagagcggcgtggtgttcgcccagagagccttcgaccacgagcagctgagagccttcgagctgaccctgcaggccagagaccagggcagccccgccctgagcgccaacgtgagcctgagagtgctggtgggcgacctgaacgacaacgcccccagagtgctgtaccccgccctgggccccgacggcagcgccctgttcgacatggtgcccagagccgccgagcccggctacctggtgaccaaggtggtggccgtggacgccgacagcggccacaacgcctggctgagctaccacgtgctgcaggccagcgagcccggcctgttcagcctgggcctgagaaccggcgaggtgagaaccgccagagccctgggcgacagagacgccgccagacagagactgctggtggccgtgagagacggcggccagccccccctgagcgccaccgccaccctgcacctgatcttcgccgacagcctgcaggaggtgctgcccgacctgagcgacagacccgagcccagcgacccccagaccgagctgcagttctacctggtggtggccctggccctgatcagcgtgctgttcctgctggccgtgatcctggccatcgccctgagactgagaagaagcagcagcctggacaccgagggctgcttccagaccggcctgtgcagcaagagcggccccggcgtgccccccaaccacagcgagggcaccctgccctacagctacaacctgtgcatcgccagccacagcgccaagaccgagttcaacagcctgaacctgacccccgagatggcccccccccaggacctgctgtgcgacgaccccagcatggtggtgtgcgccagcaacgaggaccacaagatcgcctacgaccccagcctgagcagccaccaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95758 - DNA, 2796 bp, Artificial Sequence
  Description of Artificial Sequence: Synthetic coding sequence
atgaaggccagcagcggcagatgcggcctggtgagatggctgcaggtgctgctgcccttcctgctgagcctgttccccggcgccctgcccgtgcagatcagatacagcatccccgaggagctggccaagaacagcgtggtgggcaacctggccaaggacctgggcctgagcgtgagagacctgcccgccagaaagctgagagtgagcgccgagaaggagtacttcaccgtgaaccccgagagcggcgacctgctggtgagcgacagaatcgacagagagcagatctgcggcaagcagcccctgtgcgtgctggacttcgacaccgtggccgagaaccccctgaacatcttctacatcgccgtgatcgtgcaggacatcaacgacaacacccccctgttcaagcagaccaagatcaacctgaagatcggcgagagcaccaagcccggcaccaccttccccctggaccccgccctggacagcgacgtgggccccaacagcctgcagagataccacctgaacgacaacgagtacttcgacctggccgagaagcagacccccgacggcagaaagtaccccgagctgatcctgaagcacagcctggacagagaggagcacagcctgcaccagctggtgctgaccgccgtggacggcggcgaccccccccagagcggcaccacccagatcagaatcaaggtgaccgacgccaacgacaacccccccgtgttcagccaggacgtgtacagagtgaccctgagagaggacgtgccccccggcttcttcgtgctgcaggtgaccgccaccgacagagacgagggcatcaacgccgagatcacctacagcttccacaacgtggacgagcaggtgaagcacttcttcaacctgaacgagaagaccggcgagatcaccaccaaggacgacctggacttcgagatcgccagcagctacaccctgagcatcgaggccaaggaccccggcgacctggccgcccactgcagcatccaggtggagatcctggacgacaacgactgcgcccccgaggtgatcgtgaccagcgtgagcacccccctgcccgaggacagcccccccggcaccgtgatcgccctgatcaagaccagagacagagacagcggcgagaacggcgaggtgtactgccaggtgctgggcaacgccaagttcatcctgaagagcagcagcaagaactactacaagctggtgaccgacggcgccctggacagagaggagatccccgagtacaacctgaccatcaccgccaccgacggcggcaagccccccctgagcagcagcatcatcgtgaccctgcacatcagcgacgtgaacgacaacgcccccgtgttccagcagaccagctacatggtgcacgtggccgagaacaacccccccggcgccagcatcgcccagatcagcgccagcgaccccgacctgggccccagcggccaggtgagctacagcatcgtggccagcgacctgaagcccagagagatcctgagctacgtgagcgtgagcgcccagagcggcgtggtgttcgcccagagagccttcgaccacgagcagctgagagccttcgagctgaccctgcaggccagagaccagggcagccccgccctgagcgccaacgtgagcctgagagtgctggtgggcgacctgaacgacaacgcccccagagtgctgtaccccgccctgggccccgacggcagcgccctgttcgacatggtgcccagagccgccgagcccggctacctggtgaccaaggtggtggccgtggacgccgacagcggccacaacgcctggctgagctaccacgtgctgcaggccagcgagcccggcctgttcagcctgggcctgagaaccggcgaggtgagaaccgccagagccctgggcgacagagacgccgccagacagagactgctggtggccgtgagagacggcggccagccccccctgagcgccaccgccaccctgcacctgatcttcgccgacagcctgcaggaggtgctgcccgacctgagcgacagaagagagcccagcgacccccaggccaagctgcagttctacctggtggtggccctggccctgatcagcgtgctgttcttcctggccgtgatcctggccatcagcctgagactgagactgagcagcagaagcgacgcctgggactgcttccagcccggcctgagcagcaagcccggccccggcgtgctgcccaactacagcgagggcaccctgccctacagctacaacctgtgcgtggccagccagagcgccaagaccgagttcaacttcctgaacatcacccccgagctggtgcccgcccaggacctggtgtgcgacaacgccagctgggagcagaacaccaaccacggcgccgccggcgtgcccttcgccagcgacaccatcctgaagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95759 - DNA, 2772 bp, Artificial Sequence
  Description of Artificial Sequence: Synthetic coding sequence
atgggcagcggcgccggcgagctgggcagagccgagagactgcccgtgctgttcctgttcctgctgagcctgttctgccccgccctgtgcgagcagatcagatacagaatccccgaggagatgcccaagggcagcgtggtgggcaacctggccaccgacctgggcttcagcgtgcaggagctgcccaccagaaagctgagagtgagcagcgagaagccctacttcaccgtgagcgccgagagcggcgagctgctggtgagcagcagactggacagagaggagatctgcggcaagaagcccgcctgcgccctggagttcgaggccgtggccgagaaccccctgaacttctaccacgtgaacgtggagatcgaggacatcaacgaccacacccccaagttcacccagaacagcttcgagctgcagatcagcgagagcgcccagcccggcaccagattcatcctgggcagcgcccacgacgccgacatcggcagcaacaccctgcagaactaccagctgagccccagcgaccacttcagcctgatcaacaaggagaagagcgacggcagcaagtaccccgagatggtgctgaagacccccctggacagagagaagcagaagagctaccacctgaccctgaccgccctggacttcggcgccccccccctgagcagcaccgcccagatccacgtgctggtgaccgacgccaacgacaacgcccccgtgttcagccaggacgtgtacagagtgagcctgagcgagaacgtgtaccccggcaccaccgtgctgcaggtgaccgccaccgaccaggacgagggcgtgaacgccgagatcaccttcagcttcagcgaggccagccagatcacccagttcgacctgaacagcaacaccggcgagatcaccgtgctgaacaccctggacttcgaggaggtgaaggagtacagcatcgtgctggaggccagagacggcggcggcatgatcgcccagtgcaccgtggaggtggaggtgatcgacgagaacgacaacgcccccgaggtgatcttccagagcctgcccaacctgatcatggaggacgccgagctgggcacccacatcgccctgctgaaggtgagagacaaggacagcagacacaacggcgaggtgacctgcaagctggagggcgacgtgcccttcaagatcctgaccagcagcagaaacacctacaagctggtgaccgacgccgtgctggacagagagcagaaccccgagtacaacatcaccgtgaccgccaccgacagaggcaagccccccctgagcagcagcagcagcatcaccctgcacatcggcgacgtgaacgacaacgcccccgtgttcagccagagcagctacatcgtgcacgtggccgagaacaacccccccggcgccagcatcagccaggtgagagccagcgaccccgacctgggccccaacggccaggtgagctactgcatcatggccagcgacctggagcagagagagctgagcagctacgtgagcatcagcgccgagagcggcgtggtgttcgcccagagagccttcgaccacgagcagctgagagccttcgagctgaccctgcaggccagagaccagggcagccccgccctgagcgccaacgtgagcctgagagtgctggtggacgacagaaacgacaacgcccccagagtgctgtaccccgccctgggccccgacggcagcgccctgttcgacatggtgccccacgccgccgagcccggctacctggtgaccaaggtggtggccgtggacgccgacagcggccacaacgcctggctgagctaccacgtgctgcaggccagcgagcccggcctgttcagcctgggcctgagaaccggcgaggtgagaaccgccagagccctgggcgacagagacgccgtgagacagagactgctggtggccgtgagagacggcggccagccccccctgagcgccaccgccaccctgcacctggtgttcgccgacagcctgcaggaggtgctgcccgacatcaccgacagacccgaccccagcgacctgcaggccgagctgcagttctacctggtggtggccctggccctgatcagcgtgctgttcctggtggccatgatcctggccatcgccctgagactgagaagaagcagcagccccgccagctggagctgcttccagcccggcctgtgcgtgaagagcgagagcgtggtgccccccaactacagcgagggcaccctgccctacagctacaacctgtgcgtggcccacaccggcaagaccgagttcaacttcctgaagtgcagcgagcagctgagcagcggccaggacatcctgtgcggcgacagcagcggcgccctgttccccctgtgcaacagcagcgagctgaccagccaccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95760 - DNA, 2793 bp, Artificial Sequence
  Description of Artificial Sequence: Synthetic coding sequence
atgggcggcagctgcgcccagagaagaagagccggccccagacaggtgctgttccccctgctgctgcccctgttctaccccaccctgagcgagcccatcagatacagcatccccgaggagctggccaagggcagcgtggtgggcaacctggccaaggacctgggcctgagcgtgctggacgtgagcgccagaaagctgagagtgagcgccgagaagctgcacttcagcgtggacgccgagagcggcgacctgctggtgaagaacagaatcgacagagagcagatctgcaaggagagaagaagatgcgagctgcagctggaggccgtggtggagaaccccctgaacatcttccacgtgatcgtggtgatcgaggacgtgaacgaccacgccccccagttcgacaagaaggagatccacctggagatcttcgagagcgccagcgccggcaccagactgagcctggaccccgccaccgaccccgacatcaacatcaacagcatcaaggactacaagatcaacagcaacccctacttcagcctgatggtgagagtgaacagcgacggcggcaagtaccccgagctgagcctggagaagctgctggacagagaggagcagagaagccacagcctgatcctgaccgccctggacggcggcgacccccccagaagcgccaccgcccacatcgagatcagcgtgaaggacaccaacgacaacccccccgtgttcagcagagacgagtacagaatcagcctgagcgagaacctgccccccggcagccccgtgctgcaggtgaccgccaccgaccaggacgagggcgtgaacgccgagatcaactactacttcagaagcaccgcccagagcaccaagcacatgttcagcctggacgagaagaccggcatgatcaagaacaaccagagcttcgacttcgaggacgtggagagatacaccatggaggtggaggccaaggacggcggcggcctgagcacccagtgcaaggtgatcatcgagatcctggacgagaacgacaacagccccgagatcatcatcaccagcctgagcgaccagatcctggagaacagcccccccggcatggtggtggccctgttcaagaccagagacctggacttcggcggcaacggcgaggtgagatgcaacatcgagaccgacatccccttcaagatctacagcagcagcaacaactactacaagctggtgaccgacggcgccctggacagagagcagacccccgagtacaacgtgaccatcgtggccaccgacagaggcaagccccccctgagcagcagcagaagcatcaccctgtacgtggccgacatcaacgacaacgcccccgtgttcgaccagaccagctacgtggtgcacgtggccgagaacaacccccccggcgccagcatcgcccaggtgagcgccagcgaccccgacctgggcctgaacggccacatcagctacagcatcgtggccagcgacctggagcccctggccgtgagcagctacgtgagcgtgagcgcccagagcggcgtggtgttcgcccagagagccttcgaccacgagcagctgagagccttcgccctgaccctgcaggccagagaccacggcagccccaccctgagcgccaacgtgagcctgagagtgctggtgggcgacagaaacgacaacgcccccagagtgctgtaccccgccctgggccccgacggcagcgccttcttcgacatggtgcccagaagcgccgagcccggctacctggtgaccaaggtggtggccgtggacgccgacagcggccacaacgcctggctgagctaccacgtgctgcaggccagcgagcccggcctgttcagcctgggcctgagaaccggcgaggtgagaaccgccagagccctgggcgacagagacgccgccagacagagactgctggtggccgtgagagacggcggccagccccccctgagcgccaccgccaccctgcacctggtgttcgccgacaacctgcaggagatcctgcccgacctgagcgacagacccgtgctgagcgacccccaggccgagctgcagttctacctggtggtggccctggccctgatcagcgtgctgttcctgctggccgtgatcctggccatcgccctgagactgagaagaagcctgagccccgccacctgggactgcttccaccccggcctgtgcgtgaagagcggccccgtggtgccccccaactacagcgagggcaccctgccctacagctacaacctgtgcatcgcccacaccggcaccaaggagttcaacttcctgaagtgcagcgtgcccctgcacagcaacgaggacatggtgtgcagcgtgagccccggcgccctgatccccccccacggcggcgaggacctgaccagccaccccgagaccctgaccagccaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95761 - DNA, 2790 bp, Artificial Sequence
  Description of Artificial Sequence: Synthetic coding sequence
atgggcggcagctgcgcccagagaagaagagccggccccagacaggtgctgttccccctgctgctgcccctgttctaccccaccctgtgcgagcccatcagatacagcatccccgaggagctggccaagggcagcgtggtgggcaacctggccaaggacctgggcctgagcgtgctggacgtgagcgccagagagctgagagtgagcgccgagaagctgcacttcagcgtggacgcccagagcggcgacctgctggtgaaggacagaatcgacagagagcagatctgcaaggagagaagaagatgcgagctgcagctggaggccgtggtggagaaccccctgaacatcttccacgtgatcgtggtgatcgaggacgtgaacgaccacgccccccagttcagaaaggacgagatcaacctggagatcagcgagagcgtgagcctgggcatgggcaccatcctggagagcgccgaggaccccgacatcagcatgaacagcctgagcaagtaccagctgagccccaacgagtacttcagcctggtggagaaggacaaccccgacggcggcaagtaccccgagctggtgctgcagaagaccctggacagagagacccagagcgcccaccacctggtgctgaccgccctggacggcggcgacccccccagaagcggcaccgcccagatcagaatcctggtgatcgacgccaacgacaacccccccgtgttcagccaggacgtgtacagagtgagcctgagagaggacgtgccccccggcaccagcatcctgagagtgaaggccaccgaccaggacgagggcatcaacagcgagatcacctacagcttcttcggcgtggccgacaaggcccagcacgtgttcagcctggactacaccaccggcaacatcctgacccagcagcccctggacttcgaggaggtggagagatacaccatcaacatcgaggccaaggacagaggcagcctgagcaccagatgcaaggtgatcgtggaggtggtggacgagaacgacaacagccccgagatcatcatcaccagcctgagcgaccagatcatggaggacagcccccccggcgtggtggtggccctgttcaagaccagagaccaggacagcggcgagaacggcgaggtgagatgcagcctgagcagaggcgtgcccttcaagatccacagcagcagcaacaactactacaagctggtgaccgacgaggccctggacagagagcagacccccgagtacaacgtgaccatcgccgccaccgacagaggcaagccccccctgagcagcagcaagaccatcaccctgcacatcaccgacgtgaacgacaacgcccccgtgttcggccagagcgcctacctggtgcacgtgcccgagaacaaccagcccggcgccagcatcgcccaggtgagcgccagcgaccccgacttcggcctgaacggcagagtgagctacagcctgatcgccagcgacctggagagcagaaccctgagcagctacgtgagcgtgagcgcccagagcggcgtggtgttcgcccagagagccttcgaccacgagcagctgagaaccttcgagctgaccctgcaggccagagaccagggcagccccgccctgagcgccaacgtgagcctgagagtgctggtgggcgacagaaacgacaacgcccccagagtgctgtaccccgccctgggccccgacggcagcgccctgttcgacaccgtgcccagagccgcccagcccggctacctggtgaccaaggtggtggccgtggacgccgacagcggccacaacgcctggctgagctaccacgtggtgcaggccagcgagcccggcctgttcagcctgggcctgagaaccggcgaggtgagaatggtgagagccctgggcgacaaggacagcgtgagacagagactgctggtggccgtgagagacggcggccagccccccctgagcgccaccgccaccctgcacctggtgttcgccgacagcctgcaggaggtgctgcccgacttcagcgaccaccccacccccagcgacagccaggccgagatgcagttctacctggtggtggccctggccctgatcagcgtgctgttcctgctggccgtgatcctggccatcgccctgagactgagacagagcttcagccccaccgccggcgactgcttcgagagcgtgctgtgcagcaagagcggccccgtgggcccccccaactacagcgagggcaccctgccctacgcctacaacttctgcgtgcccggcgaccagatgaaccccgagttcaacttcttcaccagcgtggaccactgccccgccacccaggacaacctgaacaaggacagcatgctgctggccagcatcctgacccccagcgtggaggccgacaagaagatcctgaagcagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95762 - DNA, 2805 bp, Artificial Sequence
  Description of Artificial Sequence: Synthetic coding sequence
atggtgcccgaggcctggagaagcggcctggtgagcaccggcagagtggtgggcgtgctgctgctgctgggcgccctgaacaaggccagcaccgtgatccactacgagatccccgaggagagagagaagggcttcgccgtgggcaacgtggtggccaacctgggcctggacctgggcagcctgagcgccagaagattcagagtggtgagcggcgccagcagaagattcttcgaggtgaacagagagaccggcgagatgttcgtgaacgacagactggacagagaggagctgtgcggcaccctgcccagctgcaccgtgaccctggagctggtggtggagaaccccctggagctgttcagcgtggaggtggtgatccaggacatcaacgacaacaaccccgccttccccacccaggagatgaagctggagatcagcgaggccgtggcccccggcaccagattccccctggagagcgcccacgaccccgacgtgggcagcaacagcctgcagacctacgagctgagcagaaacgagtacttcgccctgagagtgcagaccagagaggacagcaccaagtacgccgagctggtgctggagagagccctggacagagagagagagcccagcctgcagctggtgctgaccgccctggacggcggcacccccgccctgagcgccagcctgcccatccacatcaaggtgctggacgccaacgacaacgcccccgtgttcaaccagagcctgtacagagccagagtgctggaggacgcccccagcggcaccagagtggtgcaggtgctggccaccgacctggacgagggccccaacggcgagatcatctacagcttcggcagccacaacagagccggcgtgagacagctgttcgccctggacctggtgaccggcatgctgaccatcaagggcagactggacttcgaggacaccaagctgcacgagatctacatccaggccaaggacaagggcgccaaccccgagggcgcccactgcaaggtgctggtggaggtggtggacgtgaacgacaacgcccccgagatcaccgtgaccagcgtgtacagccccgtgcccgaggacgcccccctgggcaccgtgatcgccctgctgagcgtgaccgacctggacgccggcgagaacggcctggtgacctgcgaggtgccccccggcctgcccttcagcctgaccagcagcctgaagaactacttcaccctgaagaccagcgccgacctggacagagagaccgtgcccgagtacaacctgagcatcaccgccagagacgccggcacccccagcctgagcgccctgaccatcgtgagagtgcaggtgagcgacatcaacgacaaccccccccagagcagccagagcagctacgacgtgtacatcgaggagaacaacctgcccggcgcccccatcctgaacctgagcgtgtgggaccccgacgccccccagaacgccagactgagcttcttcctgctggagcagggcgccgagaccggcctggtgggcagatacttcaccatcaacagagacaacggcatcgtgagcagcctggtgcccctggactacgaggacagaagagagttcgagctgaccgcccacatcagcgacggcggcacccccgtgctggccaccaacatcagcgtgaacatcttcgtgaccgacagaaacgacaacgccccccaggtgctgtaccccagacccggcggcagcagcgtggagatgctgcccagaggcaccagcgccggccacctggtgagcagagtggtgggctgggacgccgacgccggccacaacgcctggctgagctacagcctgctgggcagccccaaccagagcctgttcgccatcggcctgcacaccggccagatcagcaccgccagacccgtgcaggacaccgacagccccagacagaccctgaccgtgctgatcaaggacaacggcgagcccagcctgagcaccaccgccaccctgaccgtgagcgtgaccgaggacagccccgaggccagagccgagttccccagcggcagcgcccccagagagcagaagaagaacctgaccttctacctgctgctgagcctgatcctggtgagcgtgggcttcgtggtgaccgtgttcggcgtgatcatcttcaaggtgtacaagtggaagcagagcagagacctgtacagagcccccgtgagcagcctgtacagaacccccggccccagcctgcacgccgacgccgtgagaggcggcctgatgagcccccacctgtaccaccaggtgtacctgaccaccgacagcagaagaagcgaccccctgctgaagaagcccggcgccgccagccccctggccagcagacagaacaccctgagaagctgcgaccccgtgttctacagacaggtgctgggcgccgagagcgccccccccggccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95763 - DNA, 2817 bp, Artificial Sequence
  Description of Artificial Sequence: Synthetic coding sequence
atgctgagaaaggtgagaagctggaccgagatctggagatgggccaccctgctgttcctgttctaccacctgggctacgtgtgcggccagatcagataccccgtgcccgaggagagccaggagggcaccttcgtgggcaacgtggcccaggacttcctgctggacaccgacagcctgagcgccagaagactgcaggtggccggcgaggtgaaccagagacacttcagagtggacctggacagcggcgccctgctgatcaagaaccccatcgacagagaggccctgtgcggcctgagcgccagctgcatcgtgcccctggagttcgtgaccgagggccccctggagatgtacagagccgaggtggagatcgtggacgtgaacgaccacgcccccagattccccagacagcagctggacctggagatcggcgaggccgccccccccggccagagattccccctggagaaggcccaggacgccgacgtgggcagcaacagcatcagcagctacagactgagcagcaacgagcacttcgccctggacgtgaagaagagaagcgacggcagcctggtgcccgagctgctgctggagaagcccctggacagagagaagcagagcgactacagactggtgctgaccgccgtggacggcggcaacccccccagaagcggcaccgccgagctgagagtgagcgtgctggacgtgaacgacaacgcccccgccttccagcagagcagctacagaatcagcgtgctggagagcgcccccgccggcatggtgctgatccagctgaacgccagcgaccccgacctgggccccagcggcaacgtgaccttctacttcagcggccacacccccgacagagtgagaaacctgttcagcctgcaccccaccaccggcaagctgaccctgctgggccccctggacttcgagagcgagaactactacgagttcgacgtgagagccagagacggcggcagccccgccatggagcagcactgcagcctgagagtggacctgctggacgtgaacgacaacgccccctacatcaccgtgaccagcgagctgggcaccctgcccgagagcgccgagcccggcaccgtggtggccctgatcagcgtgcaggaccccgacagcggcagcaacggcgacgtgagcctgagaatccccgaccacctgcccttcgccctgaagagcgccttcagaaaccagttcagcctggtgaccgccggccccctggacagagaggccaagagcagctacgacatcatggtgaccgccagcgacgccggcaacccccccctgagcacccacagaaccatcttcctgaacatcagcgacgtgaacgacaacccccccagcttcttccagagaagccacgaggtgttcgtgcccgagaacaacagacccggcgacctgctgtgcagcctggccgccagcgaccccgacagcggcctgaacgccctgatcagctacagcctgctggagcccagaaacagagacgtgagcgccagcagcttcatcagcctgaacccccagaccggcgccgtgcacgccaccagaagcttcgactacgagcagacccagaccctgcagttcgaggtgcaggccagagacagaggcaacccccccctgagcagcaccgtgaccgtgagactgttcgtgctggacctgaacgacaacgcccccgccgtgctgagacccagagccagacccggcagcctgtgcccccaggccctgccccccagcgtgggcgccggccacctgatcaccaaggtgaccgccgtggacctggacagcggctacaacgcctgggtgagctaccagctgctggaggcccccgaccccagcctgttcgccgtgagcagatacgccggcgaggtgagaaccgccgtgcccatccccgccgacctgcccccccagaagctggtgatcgtggtgaaggacagcggcagcccccccctgagcaccagcgtgaccctgctggtgagcctggaggaggacacccaccccgtggtgcccgacctgagagagagcagcgcccccagagagggcgagagcagactgaccctgtacctggccgtgagcctggtggccatctgcttcgtgagcttcggcagcttcgtggccctgctgagcaagtgcctgagaggcgccgcctgcggcgtgacctgcttccccgccggcacctgcgcctgcctgaccagaagcagaagaagagagggcctgccccccagcaacggcatcctgagaatccagctgggcagcgacgaccccatcaagttcgtggacgtgggcggccacagccacggctgcacccccctggccagcgcccccaccagaagcgacagcttcatgatggtgaagagccccagcgcccccatggccggcgagcccgtgagacccagctgcccccccagcgacctgctgtacggcctggagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95764 - DNA, 2835 bp, Artificial Sequence
  Description of Artificial Sequence: Synthetic coding sequence
atgggccccaagaccctgccccagctggccggcaagtggcaggtgctgtgcatgctgagcctgtgctgctggggctgggtgagcggccagctgagatacagcgtggtggaggagagcgagcccggcaccctggtgggcaacgtggcccaggacctgggcctgaagatgaccgacctgctgagcagaagactgcagctgggcagcgaggagaacggcagatacttcagcctgagcctgatgagcggcgccctggccgtgaaccagaagatcgacagagagagcctgtgcggcgccagcaccagctgcctgctgcccgtgcaggtggtgaccgagcaccccctggagctgatcagagtggaggtggagatcctggacctgaacgacaacagccccagcttcgccacccccgagagagagatgagaatcagcgagagcgccgccagcggcgccagattccccctggacagcgcccaggaccccgacgtgggcaccaacaccgtgagcttctacaccctgagccccaacagccacttcagcctgaacgtgaagaccctgaaggacggcaagcccttccccgagctggtgctggagcagcagctggacagagaggcccaggccagacaccagctggtgctgaccgccgtggacggcggcacccccgccagaagcggcaccaccctgatcagcgtgatcgtgctggacatcaacgacaacgcccccaccttccagagcagcgtgctgagagtgggcatccccgagaacgcccccatcggcaccctgctgctgagactgaacgccaccgaccccgacgagggcaccaacggccagctggactacagcttcggcgaccacaccagcgaggccgtgagaaacctgttcggcctggaccccagcagcggcgccatccacgtgctgggccccatcgacttcgaggagagcagattctacgagatccacgccagagccagagaccagggccagcccgccatggagggccactgcgtgatccaggtggacgtgggcgacgtgaacgacaacgcccccgaggtgctgctggccagcctggccaaccccgtgctggagagcacccccgtgggcaccgtggtgggcctgttcaacgtgagagacagagacagcggcagaaacggcgaggtgagcctggacatcagccccgacctgcccttccagatcaagcccagcgagaaccactacagcctgctgaccagccagcccctggacagagaggccaccagccactacatcatcgagctgctggccagcgacgccggcagccccagcctgcacaagcacctgaccatcagactgaacatcagcgacgtgaacgacaacgcccccagattcaaccagcagctgtacaccgcctacatcctggagaacagaccccccggcagcctgctgtgcaccgtggccgccagcgaccccgacaccggcgacaacgccagactgacctacagcatcgtgggcaaccaggtgcagggcgcccccgccagcagcttcgtgtacgtgaaccccgaggacggcagaatcttcgcccagagaaccttcgactacgagctgctgcagatgctgcagatcgtggtgggcgtgagagacagcggcagcccccccctgcacgccaacaccagcctgcacgtgttcgtgctggacgagaacgacaacgcccccgccgtgctgcaccccagacccgactgggagcacagcgccccccagagactgcccagaagcgccccccccggcagcctggtgaccaaggtgaccgccgtggacgccgacgccggccacaacgcctggctgagctacagcctgctgccccagagcaccgcccccggcctgttcctggtgagcacccacaccggcgaggtgagaaccgccagagccctgctggaggacgacagcgacacccagcaggtggtggtgctggtgagagacaacggcgaccccagcctgagcagcaccgccaccgtgctgctggtgctggaggacgaggaccccgaggagatgcccaagagcagcgacttcctgatccacccccccgagagaagcgacctgaccctgtacctgatcgtggccctggccaccgtgagcctgctgagcctggtgaccttcaccttcctgagcgccaagtgcctgcagggcaacgccgacggcgacggcggcggcggccagtgctgcagaagacaggacagccccagccccgacttctacaagcagagcagccccaacctgcaggtgagcagcgacggcaccctgaagtacatggaggtgaccctgagacccaccgacagccagagccactgctacagaacctgcttcagccccgccagcgacggcagcgacttcaccttcctgagacccctgagcgtgcagcagcccaccgccctggccctggagcccgacgccatcagaagcagaagcaacaccctgagagagagaagccagcaggccccccccaacaccgactggagattcagccaggcccagagacccggcaccagcggcagccagaacggcgacgacaccggcacctggcccaacaaccagttcgacaccgagatgctgcaggccatgatcctggccagcgccagcgaggccgccgacggcagcagcaccctgggcggcggcgccggcaccatgggcctgagcgccagatacggcccccagttcaccctgcagcacgtgcccgactacagacagaacgtgtacatccccggcagcaacgccaccctgaccaacgccgccggcaagagagacggcaaggcccccgccggcggcaacggcaacaagaagaagagcggcaagaaggagaagaagtag

SEQ ID NO: 95765 - DNA, 5868 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatcctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95766 - DNA, 5874 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaacctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95767 - DNA, 2886 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccgtgagcagaagacactag

SEQ ID NO: 95768 - DNA, 2430 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95769 - DNA, 5055 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacgtgccccccagcggcgtgcccaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaagtacgagatgccccagtacggcagcagaagaagactgctgccccccgccggccaggaggagtacggcgaggtggtgggcgaggccgaggaggagtacgaggaggaggagtgggccagaaagagaatgatcaagctggtggtggacagagagtacgagaccagcagcaccggcgaggacagcgcccccgagtgccagagaaacagactgcaccaccccagcatccacagcaacatcaacggcaacatctacatcgcccagaacggcagcgtggtgagaaccagaagagcctgcctgaccgacaacctgaaggtggccagccccgtgagactgggcggccccttcaagaagctggacaagctggccgtgacccacgaggagaacgtgcccctgaacaccctgagcaagggccccttcagcaccgagaagatgaacgccagacccaccctggtgaccttcgccccctgccccgtgggcaccgacaacaccgccgtgaagcccctgagaaacagactgaagagcaccgtggagcaggagagcatgatcgacagcaagaacatcaaggaggccctggagttccacagcgaccacacccagagcgacgacgaggagctgtggatgggcccctggaacaacctgcacatccccatgaccaagctgtag

SEQ ID NO: 95770 - DNA, 5859 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatcctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95771 - DNA, 5748 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatcctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95772 - DNA, 5799 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaacctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95773 - DNA, 4620 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaagaactacccctggagcctggagctgatcctggccagaaacatggacaagatcatcaccgtgatgagcatgggcatgaagtgcctgaacatgggcgtggccgtggactgctaccaccagctggacagaagaaacatggtgagatggctggtgaagctgagaaagaacatgagaagaaagagaaagagccagagaaagctgaagaaccagagactgaagctggagagcctggtgagaagaaagaagtag

SEQ ID NO: 95774 - DNA, 2160 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacgaggagcccaagaagatcaagaagcccaaggtggagatcagagagcccagcgaggaggaggaggtggtggtgaccatcgagaagccccccgccgccgagcccacctacaccacctggaagagagccagaatcttccccatgatcttcaagaaggtgagaggcctggccgacaagagaggcatcgtggacctggagggcgaggagtggcagagaagactggaggaggaggacaaggactacctgaagctgaccctggaccaggaggaggccaccgagagcaccgtggagagcgaggaggagagcagcagcgactacaccgagtacagcgaggaggagagcgagttcagcgagagcgagaccaccgaggaggagagcgagagcgagacccccagcgaggaggaggagagcagcacccccgagagcgaggagagcgagagcaccgagagcgagggcgagaaggccagaaagaacatcgtgctggccagaagaagacccatggtggaggaggtgaaggaggtgaagggcagaaaggaggagccccaggaggagcagaaggagcccaagatggaggaggaggagcacagcgaggaggaggagagcggccccgcccccgtggaggagagcaccgaccccgaggcccaggacatccccgaggagggcagcgccgagagcgccagcgtggagggcggcgtggagagcgaggaggagagcgagagcggcagcagcagcagcagcagcgagagccagagcggcggcccctggggctaccaggtgcccgcctacgacagaagcaagaacgccaaccagaagaagagccccggcgccaacagcgagggctacaacaccgccctgtag

SEQ ID NO: 95775 - DNA, 1953 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggaggagcccaagaagatcaagaagcccaaggtggagatcagagagcccagcgaggaggaggaggtggtggtgaccatcgagaagccccccgccgccgagcccacctacaccacctggaagagagccagaatcttccccatgatcttcaagaaggtgagaggcctggccgacaagagaggcatcgtggacctggagggcgaggagtggcagagaagactggaggaggaggacaaggactacctgaagctgaccctggaccaggaggaggccaccgagagcaccgtggagagcgaggaggagagcagcagcgactacaccgagtacagcgaggaggagagcgagttcagcgagagcgagaccaccgaggaggagagcgagagcgagacccccagcgaggaggaggagagcagcacccccgagagcgaggagagcgagagcaccgagagcgagggcgagaaggccagaaagaacatcgtgctggccagaagaagacccatggtggaggaggtgaaggaggtgaagggcagaaaggaggagccccaggaggagcagaaggagcccaagatggaggaggaggagcacagcgaggaggaggagagcggccccgcccccgtggaggagagcaccgaccccgaggcccaggacatccccgaggagggcagcgccgagagcgccagcgtggagggcggcgtggagagcgaggaggagagcgagagcggcagcagcagcagcagcagcgagagccagagcggcggcccctggggctaccaggtgcccgcctacgacagaagcaagaacgccaaccagaagaagagccccggcgccaacagcgagggctacaacaccgccctgtag

SEQ ID NO: 95776 - DNA, 5358 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacgtgccccccagcggcgtgcccaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaagtacgagatgccccagtacggcagcagaagaagactgctgccccccgccggccaggaggagtacggcgaggtggtgggcgaggccgaggaggagtacgaggaggaggaggaggagcccaagaagatcaagaagcccaaggtggagatcagagagcccagcgaggaggaggaggtggtggtgaccatcgagaagccccccgccgccgagcccacctacaccacctggaagagagccagaatcttccccatgatcttcaagaaggtgagaggcctggccgacaagagaggcatcgtggacctggagggcgaggagtggcagagaagactggaggaggaggacaaggactacctgaagctgaccctggaccaggaggaggccaccgagagcaccgtggagagcgaggaggagagcagcagcgactacaccgagtacagcgaggaggagagcgagttcagcgagagcgagaccaccgaggaggagagcgagagcgagacccccagcgaggaggaggagagcagcacccccgagagcgaggagagcgagagcaccgagagcgagggcgagaaggccagaaagaacatcgtgctggccagaagaagacccatggtggaggaggtgaaggaggtgaagggcagaaaggaggagccccaggaggagcagaaggagcccaagatggaggaggaggagcacagcgaggaggaggagagcggccccgcccccgtggaggagagcaccgaccccgaggcccaggacatccccgaggagggcagcgccgagagcgccagcgtggagggcggcgtggagagcgaggaggagagcgagagcggcagcagcagcagcagcagcgagagccagagcggcggcccctggggctaccaggtgcccgcctacgacagaagcaagaacgccaaccagaagaagagccccggcgccaacagcgagggctacaacaccgccctgtag

SEQ ID NO: 95777 - DNA, 2946 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcgaggagcccaagaagatcaagaagcccaaggtggagatcagagagcccagcgaggaggaggaggtggtggtgaccatcgagaagccccccgccgccgagcccacctacaccacctggaagagagccagaatcttccccatgatcttcaagaaggtgagaggcctggccgacaagagaggcatcgtggacctggagggcgaggagtggcagagaagactggaggaggaggacaaggactacctgaagctgaccctggaccaggaggaggccaccgagagcaccgtggagagcgaggaggagagcagcagcgactacaccgagtacagcgaggaggagagcgagttcagcgagagcgagaccaccgaggaggagagcgagagcgagacccccagcgaggaggaggagagcagcacccccgagagcgaggagagcgagagcaccgagagcgagggcgagaaggccagaaagaacatcgtgctggccagaagaagacccatggtggaggaggtgaaggaggtgaagggcagaaaggaggagccccaggaggagcagaaggagcccaagatggaggaggaggagcacagcgaggaggaggagagcggccccgcccccgtggaggagagcaccgaccccgaggcccaggacatccccgaggagggcagcgccgagagcgccagcgtggagggcggcgtggagagcgaggaggagagcgagagcggcagcagcagcagcagcagcgagagccagagcggcggcccctggggctaccaggtgcccgcctacgacagaagcaagaacgccaaccagaagaagagccccggcgccaacagcgagggctacaacaccgccctgtag

SEQ ID NO: 95778 - DNA, 3453 bp, Artificial Sequence
  Description of Artificial Sequence: Synthetic coding sequence
atgcccagctaccagggctacatcctggagagcgcccccgtgggcgccaccatcagcgacagcctgaacctgaccagccccctgagaatcgtggccctggacaaggacatcgaggacgtgccccccagcggcgtgcccaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagttcaaggtgagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgcacaagaactacccctggagcctggagctgatcctggccagaaacatggacaagatcatcaccgtgatgagcatgggcatgaagtgcctgaacatgggcgtggccgtggactgctaccaccagctggacagaagaaacatggtgagatggctggtgaagctgagaaagaacatgagaagaaagagaaagagccagagaaagctgaagaaccagagactgaagctggagagcctggtgagaagaaagaagtag

SEQ ID NO: 95779 - DNA, 990 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgacctgggcagcctgtgcagcggcaccaacagctggtgccagggcagaagcggcgtgcactggagcagccccgcctggagatgcctgttccccagaagactgcaccagatgtag

SEQ ID NO: 95780 - DNA, 5046 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacggctggagatacatgtactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacagagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatcctgtactacagatacgagatgccccagtacggcagcagaagaagactgctgccccccgccggccaggaggagtacggcgaggtggtgggcgaggccgaggaggagtacgaggaggaggagtgggccagaaagagaatgatcaagctggtggtggacagagagtacgagaccagcagcaccggcgaggacagcgcccccgagtgccagagaaacagactgcaccaccccagcatccacagcaacatcaacggcaacatctacatcgcccagaacggcagcgtggtgagaaccagaagagcctgcctgaccgacaacctgaaggtggccagccccgtgagactgggcggccccttcaagaagctggacaagctggccgtgacccacgaggagaacgtgcccctgaacaccctgagcaagggccccttcagcaccgagaagatgaacgccagacccaccctggtgaccttcgccccctgccccgtgggcaccgacaacaccgccgtgaagcccctgagaaacagactgaagagcaccgtggagcaggagagcatgatcgacagcaagaacatcaaggaggccctggagttccacagcgaccacacccagagcgacgacgaggagctgtggatgggcccctggaacaacctgcacatccccatgaccaagctgtag

SEQ ID NO: 95781 - DNA, 5889 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgcctacagctacgaggactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacacttcaagagaagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgaagggcctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95782 - DNA, 5661 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagcaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacacttcaagagaagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatgaagggcctgttcctgctgtaccacttccagcagagcagaggcaacaacagcgtgagcgaggacagaaagcaccagcaggtggtgatgcccttcagcagcaacaccatcgaggcccacaagagcgcccacgtggacggcagcctgaagagcaacaagctgaagagcgccagaaagttcaccttcctgagcgacgaggacgacctgagcgcccacaaccccctgtacaaggagaacatcagccaggtgagcaccaacagcgacatcagccagagaaccgacttcgtggaccccttcagccccaagatccaggccaagagcaagagcctgagaggccccagagagaagatccagagactgtggagccagagcgtgagcctgcccagaagactgatgagaaaggtgcccaacagacccgagatcatcgacctgcagcagtggcagggcaccagacagaaggccgagaacgagaacaccggcatctgcaccaacaagagaggcagcagcaaccccctgctgaccaccgaggaggccaacctgaccgagaaggaggagatcagacagggcgagaccctgatgatcgagggcaccgagcagctgaagagcctgagcagcgacagcagcttctgcttccccagaccccacttcagcttcagcaccctgcccaccgtgagcagaaccgtggagctgaagagcgagcccaacgtgatcagcagccccgccgagtgcagcctggagctgagccccagcagaccctgcgtgctgcacagcagcctgagcagaagagagacccccatctgcatgctgcccatcgagaccgagagaaacatcttcgagaacttcgcccacccccccaacatcagccccagcgcctgccccctgcccccccccccccccatcagcccccccagccccccccccgcccccgcccccctggcccccccccccgacatcagccccttcagcctgttctgccccccccccagcccccccagcatccccctgcccctgcccccccccaccttcttccccctgagcgtgagcaccagcggcccccccaccccccccctgctgccccccttccccacccccctgcccccccccccccccagcatcccctgcccccccccccccagcgccagcttcctgagcaccgagtgcgtgtgcatcaccggcgtgaagtgcaccaccaacctgatgcccgccgagaagatcaagagcagcatgacccagctgagcaccaccaccgtgtgcaagaccgacccccagagagagcccaagggcatcctgagacacgtgaagaacctggccgagctggagaagagcgtggccaacatgtacagccagatcgagaagaactacctgagaaccaacgtgagcgagctgcagaccatgtgccccagcgaggtgaccaacatggagatcaccagcgagcagaacaagggcagcctgaacaacatcgtggagggcaccgagaagcagagccacagccagagcaccagcctgtag

SEQ ID NO: 95783 - DNA, 1965 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcagcacggcgacagcaacctgagagagagcaccggccagggcaagcactag

SEQ ID NO: 95784 - DNA, 5034 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagatgctgttcctgaacagcaccggcagagtgctggacagagacccccccatgaacatccacagcatcgtggtgcaggtgcagtgcatcaacaagaaggtgggcaccatcatctaccacgaggtgagaatcgtggtgagagacagaaacgacaacagccccaccttcaagcacgagagctactacgccaccgtgaacgagctgacccccgtgggcaccaccatcttcaccggcttcagcggcgacaacggcgccaccgacatcgacgacggccccaacggccagatcgagtacgtgatccagtacaaccccgacgaccccaccagcaacgacaccttcgagatccccctgatgctgaccggcaacatcgtgctgagaaagagactgaactacgaggacaagaccagatacttcgtgatcatccaggccaacgacagagcccagaacctgaacgagagaagaaccaccaccaccaccctgaccgtggacgtgctggacggcgacgacctgggccccatgttcctgccctgcgtgctggtgcccaacaccagagactgcagacccctgacctaccaggccgccatccccgagctgagaacccccgaggagctgaaccccatcatcgtgaccccccccatccaggccatcgaccaggacagaaacatccagccccccagcgacagacccggcatcctgtacagcatcctggtgggcacccccgaggactaccccagattcttccacatgcaccccagaaccgccgagctgagcctgctggagcccgtgaacagagacttccaccagaagttcgacctggtgatcaaggccgagcaggacaacggccaccccctgcccgccttcgccggcctgcacatcgagatcctggacgagaacaaccagagcccctacttcaccatgcccagctaccagggctacatcctggagagcgcccccgtgggcgccaccatcagcgacagcctgaacctgaccagccccctgagaatcgtggccctggacaaggacatcgaggacaccaaggaccccgagctgcacctgttcctgaacgactacaccagcgtgttcaccgtgacccagaccggcatcaccagatacctgaccctgctgcagcccgtggacagagaggagcagcagacctacaccttcagcatcaccgccttcgacggcgtgcaggagagcgagcccgtgatcgtgaacatccaggtgatggacgccaacgacaacacccccaccttccccgagatcagctacgacgtgtacgtgtacaccgacatgagacccggcgacagcgtgatccagctgaccgccgtggacgccgacgagggcagcaacggcgagatcacctacgagatcctggtgggcgcccagggcgacttcatcatcaacaagaccaccggcctgatcaccatcgcccccggcgtggagatgatcgtgggcagaacctacgccctgaccgtgcaggccgccgacaacgccccccccgccgagagaagaaacagcatctgcaccgtgtacatcgaggtgctgccccccaacaaccagagcccccccagattcccccagctgatgtacagcctggagatcagcgaggccatgagagtgggcgccgtgctgctgaacctgcaggccaccgacagagagggcgacagcatcacctacgccatcgagaacggcgacccccagagagtgttcaacctgagcgagaccaccggcatcctgaccctgggcaaggccctggacagagagagcaccgacagatacatcctgatcatcaccgccagcgacggcagacccgacggcaccagcaccgccaccgtgaacatcgtggtgaccgacgtgaacgacaacgcccccgtgttcgacccctacctgcccagaaacctgagcgtggtggaggaggaggccaacgccttcgtgggccaggtgaaggccaccgaccccgacgccggcatcaacggccaggtgcactacagcctgggcaacttcaacaacctgttcagaatcaccagcaacggcagcatctacaccgccgtgaagctgaacagagaggtgagagactactacgagctggtggtggtggccaccgacggcgccgtgcaccccagacacagcaccctgaccctggccatcaaggtgctggacatcgacgacaacagccccgtgttcaccaacagcacctacaccgtgctggtggaggagaacctgcccgccggcaccaccatcctgcagatcgaggccaaggacgtggacctgggcgccaacgtgagctacagaatcagaagccccgaggtgaagcacttcttcgccctgcaccccttcaccggcgagctgagcctgctgagaagcctggactacgaggccttccccgaccaggaggccagcatcaccttcctggtggaggccttcgacatctacggcaccatgccccccggcatcgccaccgtgaccgtgatcgtgaaggacatgaacgactacccccccgtgttcagcaagagaatctacaagggcatggtggcccccgacgccgtgaagggcacccccatcaccaccgtgtacgccgaggacgccgacccccccggcctgcccgccagcagagtgagatacagagtggacgacgtgcagttcccctaccccgccagcatcttcgaggtggaggaggacagcggcagagtgatcaccagagtgaacctgaacgaggagcccaccaccatcttcaagctggtggtggtggccttcgacgacggcgagcccgtgatgagcagcagcgccaccgtgaagatcctggtgctgcaccccggcgagatccccagattcacccaggaggagtacagacccccccccgtgagcgagctggccaccaagggcaccatggtgggcgtgatcagcgccgccgccatcaaccagagcatcgtgtacagcatcgtgagcggcaacgaggaggacaccttcggcatcaacaacatcaccggcgtgatctacgtgaacggccccctggactacgagaccagaaccagctacgtgctgagagtgcaggccgacagcctggaggtggtgctggccaacctgagagtgcccagcaagagcaacaccgccaaggtgtacatcgagatccaggacgagaacaaccacccccccgtgttccagaagaagttctacatcggcggcgtgagcgaggacgccagaatgttcaccagcgtgctgagagtgaaggccaccgacaaggacaccggcaactacagcgtgatggcctacagactgatcatcccccccatcaaggagggcaaggagggcttcgtggtggagacctacaccggcctgatcaagaccgccatgctgttccacaacatgagaagaagctacttcaagttccaggtgatcgccaccgacgactacggcaagggcctgagcggcaaggccgacgtgctggtgagcgtggtgaaccagctggacatgcaggtgatcgtgagcaacgtgccccccaccctggtggagaagaagatcgaggacctgaccgagatcctggacagatacgtgcaggagcagatccccggcgccaaggtggtggtggagagcatcggcgccagaagacacggcgacgccttcagcctggaggactacaccaagtgcgacctgaccgtgtacgccatcgacccccagaccaacagagccatcgacagaaacgagctgttcaagttcctggacggcaagctgctggacatcaacaaggacttccagccctactacggcgagggcggcagaatcctggagatcagaacccccgaggccgtgaccagcatcaagaagagaggcgagagcctgggctacaccgagggcgccctgctggccctggccttcatcatcatcctgtgctgcatccccgccatcctggtggtgctggtgagctacagacacttcaagagaagacaggccgagtgcaccaagaccgccagaatccaggccgccctgcccgccgccaagcccgccgtgcccgcccccgcccccgtggccgcccccccccccccccccccccccccccccggcgcccacctgtacgaggagctgggcgacagcagcatctacagatacgagatgccccagtacggcagcagaagaagactgctgccccccgccggccaggaggagtacggcgaggtggtgggcgaggccgaggaggagtacgaggaggaggagtgggccagaaagagaatgatcaagctggtggtggacagagagtacgagaccagcagcaccggcgaggacagcgcccccgagtgccagagaaacagactgcaccaccccagcatccacagcaacatcaacggcaacatctacatcgcccagaacggcagcgtggtgagaaccagaagagcctgcctgaccgacaacctgaaggtggccagccccgtgagactgggcggccccttcaagaagctggacaagctggccgtgacccacgaggagaacgtgcccctgaacaccctgagcaagggccccttcagcaccgagaagatgaacgccagacccaccctggtgaccttcgccccctgccccgtgggcaccgacaacaccgccgtgaagcccctgagaaacagactgaagagcaccgtggagcaggagagcatgatcgacagcaagaacatcaaggaggccctggagttccacagcgaccacacccagagcgacgacgaggagctgtggatgggcccctggaacaacctgcacatccccatgaccaagctgtag

SEQ ID NO: 95785 - DNA, 279 bp, Artificial Sequence
  Description of Artificial Sequence: Synthetic coding sequence
atgttcagacagttctacctgtggacctgcctggccagcggcatcatcctgggcagcctgttcgagatctgcctgggccagtacgacgacgactgcaagctggccagaggcggcccccccgccaccatcgtggccatcgacgaggagagcagaaacggcaccatcctggtggacaacatgctgatcaagggcaccgccggcggccccgaccccaccatcgagctgagcctgaaggacaacgtggactactgggtgctgatggaccccgtgaagcagtag

SEQ ID NO: 95786 - DNA, 3453 bp, Artificial Sequence
  Description of Artificial Sequence: Synthetic coding sequence
atggccccccccctgagacccctggccagactgagaccccccggcatgctgctgagagccctgctgctgctgctgctgctgagccccctgcccggcgtgtggtgcttcagcgagctgagcttcgtgaaggagccccaggacgtgaccgtgaccagaaaggaccccgtggtgctggactgccaggcccacggcgaggtgcccatcaaggtgacctggctgaagaacggcgccaagatgagcgagaacaagagaatcgaggtgctgagcaacggcagcctgtacatcagcgaggtggagggcagaagaggcgagcagagcgacgagggcttctaccagtgcctggccatgaacaagtacggcgccatcctgagccagaaggcccacctggccctgagcaccatcagcgccttcgaggtgcagcccatcagcaccgaggtgcacgagggcggcgtggccagattcgcctgcaagatcagcagccacccccccgccgtgatcacctgggagttcaacagaaccaccctgcccatgaccatggacagaatcaccgccctgcccaccggcgtgctgcagatctacgacgtgagccagagagacagcggcaactacagatgcatcgccgccaccgtggcccacagaagaaagagcatggaggccagcctgaccgtgatccccgccaaggagagcaagagcttccacacccccaccatcatcgccggcccccagaacatcaccaccagcctgcaccagaccgtggtgctggagtgcatggccaccggcaaccccaagcccatcatcagctggagcagactggaccacaagagcatcgacgtgttcaacaccagagtgctgggcaacggcaacctgatgatcagcgacgtgagactgcagcacgccggcgtgtacgtgtgcagagccaccacccccggcaccagaaacttcaccgtggccatggccaccctgaccgtgctggccccccccagcttcgtggagtggcccgagagcctgaccagacccagagccggcaccgccagattcgtgtgccaggccgagggcatccccagccccaagatgagctggctgaagaacggcagaaagatccacagcaacggcagaatcaagatgtacaacagcaagctggtgatcaaccagatcatccccgaggacgacgccatctaccagtgcatggccgagaacagccagggcagcatcctgagcagagccagactgaccgtggtgatgagcgaggacagacccagcgccccctacaacgtgcacgccgagaccatgagcagcagcgccatcctgctggcctgggagagacccctgtacaacagcgacaaggtgatcgcctacagcgtgcactacatgaaggccgagggcctgaacaacgaggagtaccaggtggtgatcggcaacgacaccacccactacatcatcgacgacctggagcccgccagcaactacaccttctacatcgtggcctacatgcccatgggcgccagccagatgagcgaccacgtgacccagaacaccctggaggacgtgcccctgagaccccccgagatcagcctgaccagcagaagccccaccgacatcctgatcagctggctgcccatccccgccaagtacagaagaggccaggtggtgctgtacagactgagcttcagactgagcaccgagaacagcatccaggtgctggagctgcccggcaccacccacgagtacctgctggagggcctgaagcccgacagcgtgtacctggtgagaatcaccgccgccaccagagtgggcctgggcgagagcagcgtgtggaccagccacagaacccccaaggccaccagcgtgaaggcccccaagagccccgagctgcacctggagcccctgaactgcaccaccatcagcgtgagatggcagcaggacgtggaggacaccgccgccatccagggctacaagctgtactacaaggaggagggccagcaggagaacggccccatcttcctggacaccaaggacctgctgtacaccctgagcggcctggaccccagaagaaagtaccacgtgagactgctggcctacaacaacatcgacgacggctaccaggccgaccagaccgtgagcacccccggctgcgtgagcgtgagagacagaatggtgcccccccccccccccccccaccacctgtacgccaaggccaacaccagcagcagcatcttcctgcactggagaagacccgccttcaccgccgcccagatcatcaactacaccatcagatgcaaccccgtgggcctgcagaacgccagcctggtgctgtacctgcagaccagcgagacccacatgctggtgcagggcctggagcccaacaccaagtacgagttcgccgtgagactgcacgtggaccagctgagcagcccctggagccccgtggtgtaccacagcaccctgcccgaggcccccgccggcccccccgtgggcgtgaaggtgaccctgatcgaggacgacaccgccctggtgagctggaagccccccgacggccccgagaccgtggtgaccagatacaccatcctgtacgccagcagaaaggcctggatcgccggcgagtggcaggtgctgcacagagagggcgccatcaccatggccctgctggagaacctggtggccggcaacgtgtacatcgtgaagatcagcgccagcaacgaggtgggcgagggccccttcagcaacagcgtggagctggccgtgctgcccaaggagaccagcgagagcaaccagagacccaagagactggacagcgccgacgccaaggtgtacagcggctactaccacctggaccagaagagcatgaccggcatcgccgtgggcgtgggcatcgccctgacctgcatcctgatctgcgtgctgatcctgatctacagaagcaaggccagaaagagcagcgccagcaagaccgcccagaacggcacccagcagctgcccagaaccagcgccagcctggccagcggcaacgaggtgggcaagaacctggagggcgccgtgggcaacgaggagagcctgatgcccatgatcatgcccaacagcttcatcgacgccaagggcggcaccgacctgatcatcaacagctacggccccatcatcaagaacaacagcaagaagaagtggttcttcttccaggacagcaagaagatccaggtggagcagccccagagaagattcacccccgccgtgtgcttctaccagcccggcaccaccgtgctgatcagcgacgaggacagccccagcagccccggccagaccaccagcttcagcagacccttcggcgtggccgccgacaccgagcacagcgccaacagcgagggcagccacgagaccggcgacagcggcagattcagccacgagagcaacgacgagatccacctgagcagcgtgatcagcaccaccccccccaacctgtag

SEQ ID NO: 95787 - DNA, 1434 bp, Artificial Sequence
  Description of Artificial Sequence: Synthetic coding sequence
atgggcagaaccgtggtggtgctgggcggcggcatcagcggcctggccgccagctaccacctgagcagagccccctgcccccccaaggtggtgctggtggagagcagcgagagactgggcggctggatcagaagcgtgagaggccccaacggcgccatcttcgagctgggccccagaggcatcagacccgccggcgccctgggcgccagaaccctgctgctggtgagcgagctgggcctggacagcgaggtgctgcccgtgagaggcgaccaccccgccgcccagaacagattcctgtacgtgggcggcgccctgcacgccctgcccaccggcctgagaggcctgctgagacccagcccccccttcagcaagcccctgttctgggccggcctgagagagctgaccaagcccagaggcaaggagcccgacgagaccgtgcacagcttcgcccagagaagactgggccccgaggtggccagcctggccatggacagcctgtgcagaggcgtgttcgccggcaacagcagagagctgagcatcagaagctgcttccccagcctgttccaggccgagcagacccacagaagcatcctgctgggcctgctgctgggcgccggcagaaccccccagcccgacagcgccctgatcagacaggccctggccgagagatggagccagtggagcctgagaggcggcctggagatgctgccccaggccctggagacccacctgaccagcagaggcgtgagcgtgctgagaggccagcccgtgtgcggcctgagcctgcaggccgagggcagatggaaggtgagcctgagagacagcagcctggaggccgaccacgtgatcagcgccatccccgccagcgtgctgagcgagctgctgcccgccgaggccgcccccctggccagagccctgagcgccatcaccgccgtgagcgtggccgtggtgaacctgcagtaccagggcgcccacctgcccgtgcagggcttcggccacctggtgcccagcagcgaggaccccggcgtgctgggcatcgtgtacgacagcgtggccttccccgagcaggacggcagcccccccggcctgagagtgaccgtgatgctgggcggcagctggctgcagaccctggaggccagcggctgcgtgctgagccaggagctgttccagcagagagcccaggaggccgccgccacccagctgggcctgaaggagatgcccagccactgcctggtgcacctgcacaagaactgcatcccccagtacaccctgggccactggcagaagctggagagcgccagacagttcctgaccgcccacagactgcccctgaccctggccggcgccagctacgagggcgtggccgtgaacgactgcatcgagagcggcagacaggccgccgtgagcgtgctgggcaccgagcccaacagctag

SEQ ID NO: 95788 - DNA, 1434 bp, Artificial Sequence; identical to SEQ ID NO: 95787
  Description of Artificial Sequence: Synthetic coding sequence

SEQ ID NO: 95789 - DNA, 717 bp, Artificial Sequence
  Description of Artificial Sequence: Synthetic coding sequence
atgggcagaaccgtggtggtgctgggcggcggcatcagcggcctggccgccagctaccacctgagcagagccccctgcccccccaaggtggtgctggtggagagcagcgagagactgggcggctggatcagaagcgtgagaggccccaacggcgccatcttcgagctgggccccagaggcatcagacccgccggcgccctgggcgccagaaccctgctgctgggcttcggccacctggtgcccagcagcgaggaccccggcgtgctgggcatcgtgtacgacagcgtggccttccccgagcaggacggcagcccccccggcctgagagtgaccgtgatgctgggcggcagctggctgcagaccctggaggccagcggctgcgtgctgagccaggagctgttccagcagagagcccaggaggccgccgccacccagctgggcctgaaggagatgcccagccactgcctggtgcacctgcacaagaccaagaaccagctgaagtggagacagagccacgacagaaccgtggagtggcccaaggagtaccccggcagaagcagaaagcaggcccccagcatcctgcacgtgcccggctgccagctgctgagatgcagagacagagaccacctgggcgccgtgagcgagcagcccagaagcagcgccgagagcagagtgggcgtggccagcagcaccttcagcaccttccccctgttctag

SEQ ID NO: 95790 - DNA, 1335 bp, Artificial Sequence
  Description of Artificial Sequence: Synthetic coding sequence
atgggcagaaccgtggtggtgctgggcggcggcatcagcggcctggccgccagctaccacctgagcagagccccctgcccccccaaggtggtgctggtggagagcagcgagagactgggcggctggatcagaagcgtgagaggccccaacggcgccatcttcgagctgggccccagaggcatcagacccgccggcgccctgggcgccagaaccctgctgctggcctgcggcgagcaggtgagcgagctgggcctggacagcgaggtgctgcccgtgagaggcgaccaccccgccgcccagaacagattcctgtacgtgggcggcgccctgcacgccctgcccaccggcctgagccccagcctgaccctgaaggtggccagcctggccatggacagcctgtgcagaggcgtgttcgccggcaacagcagagagctgagcatcagaagctgcttccccagcctgttccaggccgagcagacccacagaagcatcctgctgggcctgctgctgggcgccggcagaaccccccagcccgacagcgccctgatcagacaggccctggccgagagatggagccagtggagcctgagaggcggcctggagatgctgccccaggccctggagacccacctgaccagcagaggcgtgagcgtgctgagaggccagcccgtgtgcggcctgagcctgcaggccgagggcagatggaaggtgagcctgagagacagcagcctggaggccgaccacgtgatcagcgccatccccgccagcgtgctgagcgagctgctgcccgccgaggccgcccccctggccagagccctgagcgccatcaccgccgtgagcgtggccgtggtgaacctgcagtaccagggcgcccacctgcccgtgcagggcttcggccacctggtgcccagcagcgaggaccccggcgtgctgggcatcgtgtacgacagcgtggccttccccgagcaggacggcagcccccccggcctgagagtgaccgtgatgctgggcggcagctggctgcagaccctggaggccagcggctgcgtgctgagccaggagctgttccagcagagagcccaggaggccgccgccacccagctgggcctgaaggagatgcccagccactgcctggtgcacctgcacaagaactgcatcccccagtacaccctgggccactggcagaagctggagagcgccagacagttcctgaccgcccacagactgcccctgaccctggccggcgccagctacgagggcgtggccgtgaacgactgcatcgagagcggcagacaggccgccgtgagcgtgctgggcaccgagcccaacagctag

SEQ ID NO: 95791 - DNA, 144 bp, Artificial Sequence
  Description of Artificial Sequence: Synthetic coding sequence
atggacatcctgaagagcgagatcctgagaaagagacagctggtggaggacagaaacctgctgagcgagagcatgtgcgccaacgacgcctacctgcagatggccatcggcaacgccccctggcccatcggcgtgaccatgtag

SEQ ID NO: 95792 - DNA, 504 bp, Artificial Sequence
  Description of Artificial Sequence: Synthetic coding sequence
atgatcagaaccttccccggcgagaacaagaagtacttcaagagaagcgagctggccaagaaggaggaggaggcctacttcgagagatgcggctacaagatccagcccaaggaggaggaccagaagcccctgaccagcagcaaccccgtgctggagctggagctggccgaggagaagctgcccatgaccctgagcagacaggaggtgatcagaagactgagagagagaggcgagcccatcagactgttcggcgagaccgactacgacgccttccagagactgagaaagatcgagatcctgacccccgaggtgaacaagggcctgagaaacgacctgaaggccgccctggacaagatcgaccagcagtacctgaacgagatcgtgggcggccaggagcccggcgaggaggacacccagaacgacctgaaggtgcacgaggagaacaccaccatcgaggagctggaggccctgggcgagagcctgggcaagggcgacgaccactag

SEQ ID NO: 95793 - DNA, 750 bp, Artificial Sequence
  Description of Artificial Sequence: Synthetic coding sequence
atgatcagaaccttccccggcgagaacaagaagtacttcaagagaagcgagctggccaagaaggaggaggaggcctacttcgagagatgcggctacaagcccatcaacgagaagcccagcggcgagatccagcccaaggaggaggaccagaagcccctgaccagcagcaaccccgtgctggagctggagctggccgaggagaagctgcccatgaccctgagcagacaggaggtgatcagaagactgagagagagaggcgagcccatcagactgttcggcgagaccgactacgacgccttccagagactgagaaagatcgagatcctgacccccgaggtgaacaagggcctgagaaacgacctgaaggccgccctggacaagatcgaccagcagtacctgaacgagatcgtgggcggccaggagcccggcgaggaggacacccagaacgacctgaaggtgcacgaggagaacaccaccatcgaggagctggaggccctgggcgagagcctgggcaagggcgacgaccacaaggacatggacatcatcaccaagttcctgaagttcctgctgggcgtgtgggccaaggagctgaacgccagagaggactacgtgaagagaagcgtgcagggcaagctgaacagcgccacccagaagcagaccgagagctacctgagacccctgttcagaaagctgagaaagagaaacctgcccgccgacatcaaggagagcatcaccgacatcatcaagtag

SEQ ID NO: 95794 - DNA, 1029 bp, Artificial Sequence
  Description of Artificial Sequence: Synthetic coding sequence
atggacatcctgaagagcgagatcctgagaaagagacagctggtggaggacagaaacctgctggtggagaacaagaagtacttcaagagaagcgagctggccaagaaggaggaggaggcctacttcgagagatgcggctacaagatccagcccaaggaggaggaccagaagcccctgaccagcagcaaccccgtgctggagctggagctggccgaggagaagctgcccatgaccctgagcagacaggaggtgatcagaagactgagagagagaggcgagcccatcagactgttcggcgagaccgactacgacgccttccagagactgagaaagatcgagatcctgacccccgaggtgaacaagggcctgagaaacgacctgaaggccgccctggacaagatcgaccagcagtacctgaacgagatcgtgggcggccaggagcccggcgaggaggacacccagaacgacctgaaggtgcacgaggagaacaccaccatcgaggagctggaggccctgggcgagagcctgggcaagggcgacgaccacaaggacatggacatcatcaccaagttcctgaagttcctgctgggcgtgtgggccaaggagctgaacgccagagaggactacgtgaagagaagcgtgcagggcaagctgaacagcgccacccagaagcagaccgagagctacctgagacccctgttcagaaagctgagaaagagaaacctgcccgccgacatcaaggagagcatcaccgacatcatcaagttcatgctgcagagagagtacgtgaaggccaacgacgcctacctgcagatggccatcggcaacgccccctggcccatcggcgtgaccatggtgggcatccacgccagaaccggcagagagaagatcttcagcaagcacgtggcccacgtgctgaacgacgagacccagagaaagtacatccagggcctgaagagactgatgaccatctgccagaagcacttccccaccgaccccagcaagtgcgtggagtacaacgccctgtag

SEQ ID NO: 95795 - DNA, 750 bp, Artificial Sequence; identical to SEQ ID NO: 95793
  Description of Artificial Sequence: Synthetic coding sequence

SEQ ID NO: 95796 - DNA, 1083 bp, Artificial Sequence
  Description of Artificial Sequence: Synthetic coding sequence
atggacacccccctgagaagaagcagaagactgggcggcctgagacccgagagccccgagagcctgaccagcgtgagcagaaccagaagagccctggtggagttcgagagcaaccccgaggagaccagagagcccggcagcccccccagcgtgcagagagccggcctgggcagccccgagagaccccccaagaccagccccggcagccccagactgcagcagggcgccggcctggagagcccccagggccagcccgagcccggcgccgccagcccccagagacagcaggacctgcacctggagagcccccagagacagcccgagtacagccccgagagccccagatgccagcccaagcccagcgaggaggcccccaagtgcagccaggaccagggcgtgctggccagcgagctggcccagaacaaggaggagctgacccccggcgccccccagcaccagctgccccccgtgcccggcagccccgagccctaccccggccagcaggcccccggccccgagcccagccagcccctgctggagctgacccccagagcccccggcagccccagaggccagcacgagcccagcaagcccccccccgccggcgagaccgtgaccggcggcttcggcgccaagaagagaaagggcagcagcagccaggcccccgccagcaagaagctgaacaaggaggagctgcccgtgatccccaagggcaagcccaagagcggcagagtgtggaaggacagaagcaagaagagattcagccagatgctgcaggacaagcccctgagaaccagctggcagagaaagatgaaggagagacaggagagaaagctggccaaggacttcgccagacacctggaggaggagaaggagagaagaagacaggagaagaagcagagaagagccgagaacctgaagagaagactggagaacgagagaaaggccgaggtggtgcaggtgatcagaaaccccgccaagctgaagagagccaagaagaagcagctgagaagcatcgagaagagagacaccctggccctgctgcagaagcagcccccccagcagcccgccgccaagatctag

SEQ ID NO: 95797 - DNA, 1095 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggcttcagcagcaccagcgtgctgccccacaccggctacatctaccacagcgacatcgtgcagagcctgccccccgacctgagaagaaaggccgccagactggtggccgccaagtgcaccctggccgccagagtggacagcttccacgagagcaccgagggcaaggtgggctacgagctgaaggacgagatcgagagaaagttcgacaagtggcagagaagaagatggctgagacccaccagaagcatcagccccgcctggctgagcagcagcagaagcagagccagaagagtggccctgtgcccccccgagtag

SEQ ID NO: 95798 - DNA, 1500 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggcttcagcagcaccagcgtgctgccccacaccggctacatctaccacagcgacatcgtgcagagcctgccccccgacctgagaagaaaggccgccagactggtggccgccaagtgcaccctggccgccagagtggacagcttccacgagagcaccgagggcaaggtgggctacgagctgaaggacgagatcgagagaaagttcgacaagtggcaggagcccccccccgtgaagcaggtgaagcccctgcccgcccccctggacggccagagaaagaagagaggcggcagaagatacagaaagatgaaggagagactgggcctgaccgagatcagaaagcaggccaacagaatgagcttcggcgagatcgaggaggacgcctaccaggaggacctgggcttcagcctgggccacctgggcaagagcggcagcggcagagtgagacagacccaggtgaacgaggccaccaaggccagaatcagcaagaccctgcagagaaccctgcagaagcagagcgtggtgtacggcggcaagagcaccatcagagacagaagcagcggcaccgccagcagcgtggccttcacccccctgcagggcctggagatcgtgaacccccaggccgccgagaagaaggtggccgaggccaaccagaagtacttcagcagcatggccgagttcctgaaggtgaagggcgagaagagcggcctgatgagcacctag

SEQ ID NO: 95799 - DNA, 1353 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggcttcagcagcaccagcgtgctgccccacaccggctacatctaccacagcgacatcgtgcagagcctgccccccgacctgagaagaaaggccgccagactggtggccgccaagtgcaccctggccgccagagtggacagcttccacgagagcaccgagggcaaggtgggctacgagctgaaggacgagatcgagagaaagttcgacaagtggcaggagcccccccccgtgaagcaggtgaagcccctgcccgcccccctggacggccagagaaagaagagaggcggcagaagatacagaaagatgaaggagagactgggcctgaccgagatcagaaagcaggccaacagaatgagcttcggcgagatcgaggaggacgcctaccaggaggacctgggcttcagcctgggccacctggacgccgccgccgaccccgccgaggccgagagaagaatctggagagaggtgcaccaccccagacccctgctgggccacggcctgcagagaggcctgcaccccacccccggccccggcgactgcgagcccaccggcggcagagaggagggcggctag

SEQ ID NO: 95800 - DNA, 831 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggcttcagcagcaccagcgtgctgccccacaccggctacatctaccactag

SEQ ID NO: 95801 - DNA, 855 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggcttcagcagcaccagcgtgctgccccacaccggctacatctaccacagcgacatcgtgcagagcctgccctag

SEQ ID NO: 95802 - DNA, 786 bp, Artificial Sequence
  Description of Artificial Sequence: Synthetic coding sequence
atgagcctggccgacgagctgctggccgacctggaggaggccgccgaggaggaggagggcggcagctacggcgaggaggaggaggagcccgccatcgaggacgtgcaggaggagacccagctggacctgagcggcgacagcgtgaagaccatcgccaagctgtgggacagcaagatgttcgccgagatcatgatgaagatcgaggagtacatcagcaagcaggccaaggccagcgaggtgatgggccccgtggaggccgcccccgagtacagagtgatcgtggacgccaacaacctgaccgtggagatcgagaacgagctgaacatcatccacaagttcatcagagacaagtacagcaagagattccccgagctggagagcctggtgcccaacgccctggactacatcagaaccgtgaaggagctgggcaacagcctggacaagtgcaagaacaacgagaacctgcagcagatcctgaccaacgccaccatcatggtggtgagcgtgaccgccagcaccacccagggccagcagctgagcgaggaggagctggagagactggaggaggcctgcgacatggccctggagctgaacgccagcaagcacagaatctacgagtacgtggagagcagaatgagcttcatcgcccccaacctgagcatcatcatcggcgccagcaccgccgccaagatcatgggcgtggccggcggcctgaccaacctgagcaagatgcccgcctgcaacatcatgctgctgggcgcccagagaaagaccctgagcggctag

SEQ ID NO: 95803 - DNA, 1569 bp, Artificial Sequence
  Description of Artificial Sequence: Synthetic coding sequence
atggccagcagcagagccagcagcacccaggccaccaagaccaaggcccccgacgacctggtggcccccgtggtgaagaagccccacatctactacggcagcctggaggagaaggagagagagagactggccaagggcgagagcggcatcctgggcaaggacggcctgaaggccggcatcgaggccggcaacatcaacatcaccagcggcgaggtgttcgagatcgaggagcacatcagcgagagacaggccgaggtgctggccgagttcgagagaagaaagagagccagacagatcaacgtgagcaccgacgacagcgaggtgaaggcctgcctgagagccctgggcgagcccatcaccctgttcggcgagggccccgccgagagaagagagagactgagaaacatcctgagcgtggtgggcaccgacgccctgaagaagaccaagaaggacgacgagaagagcaagaagagcaaggaggagtaccagcagacctggtaccacgagggccccaacagcctgaaggtggccagactgtggatcgccaactacagcctgcccagagccatgaagagactggaggaggccagactgcacaaggagatccccgagaccaccagaaccagccagatgcaggagctgcacaagagcctgagaagcctgaacaacttctgcagccagatcggcgacgacagacccatcagctactgccacttcagccccaacagcaagatgctggccaccgcctgctggagcggcctgtgcaagctgtggagcgtgcccgactgcaacctgctgcacaccctgagaggccacaacaccaacgtgggcgccatcgtgttccaccccaagagcaccgtgagcctggaccccaaggacgtgaacctggccagctgcgccgccgacggcagcgtgaagctgtggagcctggacagcgacgagcccgtggccgacatcgagggccacaccgtgagagtggccagagtgatgtggcaccccagcggcagattcctgggcaccacctgctacgacagaagctggagactgtgggacctggaggcccaggaggagatcctgcaccaggagggccacagcatgggcgtgtacgacatcgccttccaccaggacggcagcctggccggcaccggcggcctggacgccttcggcagagtgtgggacctgagaaccggcagatgcatcatgttcctggagggccacctgaaggagatctacggcatcaacttcagccccaacggctaccacatcgccaccggcagcggcgacaacacctgcaaggtgtgggacctgagacagagaagatgcgtgtacaccatccccgcccaccagaacctggtgaccggcgtgaagttcgagcccatccacggcaacttcctgctgaccggcgcctacgacaacaccgccaagatctggacccaccccggctggagccccctgaagaccctggccggccacgagggcaaggtgatgggcctggacatcagcagcgacggccagctgatcgccacctgcagctacgacagaaccttcaagctgtggatggccgagtag

SEQ ID NO: 95804 - DNA, 1566 bp, Artificial Sequence
  Description of Artificial Sequence: Synthetic coding sequence
atggccagcagcagagccagcagcaccgccaccaagaccaaggcccccgacgacctggtggcccccgtggtgaagaagccccacatctactacggcagcctggaggagaaggagagagagagactggccaagggcgagagcggcatcctgggcaaggacggcctgaaggccggcatcgaggccggcaacatcaacatcaccagcggcgaggtgttcgagatcgaggagcacatcagcgagagacaggccgaggtgctggccgagttcgagagaagaaagagagccagacagatcaacgtgagcaccgacgacagcgaggtgaaggcctgcctgagagccctgggcgagcccatcaccctgttcggcgagggccccgccgagagaagagagagactgagaaacatcctgagcgtggtgggcaccgacgccctgaagaagaccaagaaggacgacgagaagagcaagaagagcaaggaggagtaccagcagacctggtaccacgagggccccaacagcctgaaggtggccagactgtggatcgccaactacagcctgcccagagccatgaagagactggaggaggccagactgcacaaggagatccccgagaccaccagaaccagccagatgcaggagctgcacaagagcctgagaagcctgaacaacttctgcagccagatcggcgacgacagacccatcagctactgccacttcagccccaacagcaagatgctggccaccgcctgctggagcggcctgtgcaagctgtggagcgtgcccgactgcaacctgctgcacaccctgagaggccacaacaccaacgtgggcgccatcgtgttccaccccaagagcaccgtgagcctggaccccaaggacgtgaacctggccagctgcgccgccgacggcagcgtgaagctgtggagcctggacagcgacgagcccgtggccgacatcgagggccacaccgtgagagtggccagagtgatgtggcaccccagcggcagattcctgggcaccacctgctacgacagaagctggagactgtgggacctggaggcccaggaggagatcctgcaccaggagggccacagcatgggcgtgtacgacatcgccttccaccaggacggcagcctggccggcaccggcggcctggacgccttcggcagagtgtgggacctgagaaccggcagatgcatcatgttcctggagggccacctgaaggagatctacggcatcaacttcagccccaacggctaccacatcgccaccggcagcggcgacaacacctgcaaggtgtgggacctgagacagagaagatgcgtgtacaccatccccgcccaccagaacctggtgaccggcgtgaagttcgagcccatccacggcaacttcctgctgaccggcgcctacgacaacaccgccaagatctggacccaccccggctggagccccctgaagaccctggccggccacgagggcaaggtgatgggcctggacatcagcagcgacggccagctgatcgccacctgcagctacgacagaaccttcaagctgtggatggccgagtag

SEQ ID NO: 95805 - DNA, 3024 bp, Artificial Sequence
  Description of Artificial Sequence: Synthetic coding sequence
atggccgccgccgagacccagagcctgagagagcagcccgagatggaggacgccaacagcgagaagagcatcaacgaggagaacggcgaggtgagcgaggaccagagccagaacaagcacagcagacacaagaagaagaagcacaagcacagaagcaagcacaagaagcacaagcacagcagcgaggaggacaaggacaagaagcacaagcacaagcacaagcacaagaagcacaagagaaaggagatcatcgacgccagcgacaaggagggcatgagccccgccaagagaaccaagctggacgacctggccctgctggaggacctggagaagcagagagccctgatcaaggccgagctggacaacgagctgatggagggcaaggtgcagagcggcatgggcctgatcctgcagggctacgagagcggcagcgaggaggagggcgagatccacgagaaggccagaaacggcaacagaagcagcaccagaagcagcagcaccaagggcaagctggagctggtggacaacaagatcaccaccaagaagagaagcaagagcagaagcaaggagagaaccagacacagaagcgacaagaagaagagcaagggcggcatcgagatcgtgaaggagaagaccaccagaagcaagagcaaggagagaaagaagagcaagagccccagcaagagaagcaagagccaggaccaggccagaaagagcaagagccccaccctgagaagaagaagccaggagaagatcggcaaggccagaagccccaccgacgacaaggtgaagatcgaggacaagagcaagagcaaggacagaaagaagagccccatcatcaacgagagcagaagcagagacagaggcaagaagagcagaagccccgtggacctgagaggcaagagcaaggacagaagaagcagaagcaaggagagaaagagcaagagaagcgagaccgacaaggagaagaagcccatcaagagccccagcaaggacgccagcagcggcaaggagaacagaagccccagcagaagacccggcagaagccccaagagaagaagcctgagccccaagcccagagacaagagcagaagaagcagaagccccctgctgaacgacagaagaagcaagcagagcaagagccccagcagaaccctgagccccggcagaagagccaagagcagaagcctggagagaaagagaagagagcccgagagaagaagactgagcagccccagaaccagacccagagacgacatcctgagcagaagagagagaagcaaggacgccagccccatcaacagatggagccccaccagaagaagaagcagaagccccatcagaagaagaagcagaagccccctgagaagaagcagaagccccagaagaagaagcagaagccccagaagaagagacagaggcagaagaagcagaagcagactgagaagaagaagcagaagcagaggcggcagaagaagaagaagcagaagcaaggtgaaggaggacaagttcaagggcagcctgagcgagggcatgaaggtggagcaggagagcagcagcgacgacaacctggaggacttcgacgtggaggaggaggacgaggaggccctgatcgagcagagaagaatccagagacaggccatcgtgcagaagtacaagtacctggccgaggacagcaacatgagcgtgcccagcgagcccagcagcccccagagcagcaccagaaccagaagccccagccccgacgacatcctggagagagtggccgccgacgtgaaggagtacgagagagagaacgtggacaccttcgaggccagcgtgaaggccaagcacaacctgatgaccgtggagcagaacaacggcagcagccagaagaagctgctggcccccgacatgttcaccgagagcgacgacatgttcgccgcctacttcgacagcgccagactgagagccgccggcatcggcaaggacttcaaggagaaccccaacctgagagacaactggaccgacgccgagggctactacagagtgaacatcggcgaggtgctggacaagagatacaacgtgtacggctacaccggccagggcgtgttcagcaacgtggtgagagccagagacaacgccagagccaaccaggaggtggccgtgaagatcatcagaaacaacgagctgatgcagaagaccggcctgaaggagctggagttcctgaagaagctgaacgacgccgaccccgacgacaagttccactgcctgagactgttcagacacttctaccacaagcagcacctgtgcctggtgttcgagcccctgagcatgaacctgagagaggtgctgaagaagtacggcaaggacgtgggcctgcacatcaaggccgtgagaagctacagccagcagctgttcctggccctgaagctgctgaagagatgcaacatcctgcacgccgacatcaagcccgacaacatcctggtgaacgagagcaagaccatcctgaagctgtgcgacttcggcagcgccagccacgtggccgacaacgacatcaccccctacctggtgagcagattctacagagcccccgagatcatcatcggcaagagctacgactacggcatcgacatgtggagcgtgggctgcaccctgtacgagctgtacaccggcaagatcctgttccccggcaagaccaacaaccacatgctgaagctggccatggacctgaagggcaagatgcccaacaagatgatcagaaagggcgtgttcaaggaccagcacttcgaccagaacctgaacttcatgtacatcgaggtggacaaggtgaccgagagagagaaggtgaccgtgatgagcaccatcaaccccaccaaggacctgctggccgacctgatcggctgccagagactgcccgaggaccagagaaagaaggtgcaccagctgaaggacctgctggaccagatcctgatgctggaccccgccaagagaatcagcatcaaccaggccctgcagcacgccttcatccaggagaagatctag

SEQ ID NO: 95806 - DNA, 3024 bp, Artificial Sequence; identical to SEQ ID NO: 95805
  Description of Artificial Sequence: Synthetic coding sequence

SEQ ID NO: 95807 - DNA, 2982 bp, Artificial Sequence
  Description of Artificial Sequence: Synthetic coding sequence
atggaggacgccaacagcgagaagagcatcaacgaggagaacggcgaggtgagcgaggaccagagccagaacaagcacagcagacacaagaagaagaagcacaagcacagaagcaagcacaagaagcacaagcacagcagcgaggaggacaaggacaagaagcacaagcacaagcacaagcacaagaagcacaagagaaaggagatcatcgacgccagcgacaaggagggcatgagccccgccaagagaaccaagctggacgacctggccctgctggaggacctggagaagcagagagccctgatcaaggccgagctggacaacgagctgatggagggcaaggtgcagagcggcatgggcctgatcctgcagggctacgagagcggcagcgaggaggagggcgagatccacgagaaggccagaaacggcaacagaagcagcaccagaagcagcagcaccaagggcaagctggagctggtggacaacaagatcaccaccaagaagagaagcaagagcagaagcaaggagagaaccagacacagaagcgacaagaagaagagcaagggcggcatcgagatcgtgaaggagaagaccaccagaagcaagagcaaggagagaaagaagagcaagagccccagcaagagaagcaagagccaggaccaggccagaaagagcaagagccccaccctgagaagaagaagccaggagaagatcggcaaggccagaagccccaccgacgacaaggtgaagatcgaggacaagagcaagagcaaggacagaaagaagagccccatcatcaacgagagcagaagcagagacagaggcaagaagagcagaagccccgtggacctgagaggcaagagcaaggacagaagaagcagaagcaaggagagaaagagcaagagaagcgagaccgacaaggagaagaagcccatcaagagccccagcaaggacgccagcagcggcaaggagaacagaagccccagcagaagacccggcagaagccccaagagaagaagcctgagccccaagcccagagacaagagcagaagaagcagaagccccctgctgaacgacagaagaagcaagcagagcaagagccccagcagaaccctgagccccggcagaagagccaagagcagaagcctggagagaaagagaagagagcccgagagaagaagactgagcagccccagaaccagacccagagacgacatcctgagcagaagagagagaagcaaggacgccagccccatcaacagatggagccccaccagaagaagaagcagaagccccatcagaagaagaagcagaagccccctgagaagaagcagaagccccagaagaagaagcagaagccccagaagaagagacagaggcagaagaagcagaagcagactgagaagaagaagcagaagcagaggcggcagaagaagaagaagcagaagcaaggtgaaggaggacaagttcaagggcagcctgagcgagggcatgaaggtggagcaggagagcagcagcgacgacaacctggaggacttcgacgtggaggaggaggacgaggaggccctgatcgagcagagaagaatccagagacaggccatcgtgcagaagtacaagtacctggccgaggacagcaacatgagcgtgcccagcgagcccagcagcccccagagcagcaccagaaccagaagccccagccccgacgacatcctggagagagtggccgccgacgtgaaggagtacgagagagagaacgtggacaccttcgaggccagcgtgaaggccaagcacaacctgatgaccgtggagcagaacaacggcagcagccagaagaagctgctggcccccgacatgttcaccgagagcgacgacatgttcgccgcctacttcgacagcgccagactgagagccgccggcatcggcaaggacttcaaggagaaccccaacctgagagacaactggaccgacgccgagggctactacagagtgaacatcggcgaggtgctggacaagagatacaacgtgtacggctacaccggccagggcgtgttcagcaacgtggtgagagccagagacaacgccagagccaaccaggaggtggccgtgaagatcatcagaaacaacgagctgatgcagaagaccggcctgaaggagctggagttcctgaagaagctgaacgacgccgaccccgacgacaagttccactgcctgagactgttcagacacttctaccacaagcagcacctgtgcctggtgttcgagcccctgagcatgaacctgagagaggtgctgaagaagtacggcaaggacgtgggcctgcacatcaaggccgtgagaagctacagccagcagctgttcctggccctgaagctgctgaagagatgcaacatcctgcacgccgacatcaagcccgacaacatcctggtgaacgagagcaagaccatcctgaagctgtgcgacttcggcagcgccagccacgtggccgacaacgacatcaccccctacctggtgagcagattctacagagcccccgagatcatcatcggcaagagctacgactacggcatcgacatgtggagcgtgggctgcaccctgtacgagctgtacaccggcaagatcctgttccccggcaagaccaacaaccacatgctgaagctggccatggacctgaagggcaagatgcccaacaagatgatcagaaagggcgtgttcaaggaccagcacttcgaccagaacctgaacttcatgtacatcgaggtggacaaggtgaccgagagagagaaggtgaccgtgatgagcaccatcaaccccaccaaggacctgctggccgacctgatcggctgccagagactgcccgaggaccagagaaagaaggtgcaccagctgaaggacctgctggaccagatcctgatgctggaccccgccaagagaatcagcatcaaccaggccctgcagcacgccttcatccaggagaagatctag

SEQ ID NO: 95808 - DNA, 2820 bp, Artificial Sequence
  Description of Artificial Sequence: Synthetic coding sequence
atgagacccggcaccggcgccgagagaggcggcctgatggtgagcgagatggagagccacccccccagccagggccccggcgacggcgagagaagactgagcggcagcagcctgtgcagcggcagctgggtgagcgccgacggcttcctgagaagaagacccagcatgggccaccccggcatgcactacgcccccatgggcatgcaccccatgggccagagagccaacatgccccccgtgccccacggcatgatgccccagatgatgccccccatgggcggcccccccatgggccagatgcccggcatgatgagcagcgtgatgcccggcatgatgatgagccacatgagccaggccagcatgcagcccgccctgccccccggcgtgaacagcatggacgtggccgccggcacctacaccctgtacaagagcatgtggaccgagcacaagagccccgacggcagaacctactactacaacaccgagaccaagcagagcacctgggagaagcccgacgacctgaagacccccgccgagcagctgctgagcaagtgcccctggaaggagtacaagagcgacagcggcaagccctactactacaacagccagaccaaggagagcagatgggccaagcccaaggagctggaggacctggagggcaagatgggcaagatcaagtacagcaagcaggaggagtgcaccaccaccagcaccgcccccgtgcccaccaccgagatccccaccaccatgagcaccatggccgccgccgaggccgccgccgccgtggtggccgccgccgccgccgccgccgccgccgccgccgccgccaacgccaacgccagcaccagcgccagcaacaccgtgagcggcaccgtgcccgtggtgcccgagcccgaggtgaccagcatcgtggccaccgtggtggacaacgagaacaccgtgaccatcagcaccgaggagcaggcccagctgaccagcacccccgccatccaggaccagagcgtggaggtgagcagcaacaccggcgaggagaccagcaagcaggagaccgtggccgacttcacccccaagaaggaggaggaggagagccagcccgccaagaagacctacacctggaacaccaaggaggaggccaagcaggccttcaaggagctgctgaaggagaagagagtgcccagcaacgccagctgggagcaggccatgaagatgatcatcaacgaccccagatacagcgccctggccaagctgagcgagaagaagcaggccttcaacgcctacaaggtgcagaccgagaaggaggagaaggaggaggccagaagcaagtacaaggaggccaaggagagcttccagagattcctggagaaccacgagaagatgaccagcaccaccagatacaagaaggccgagcagatgttcggcgagatggaggtgtggaacgccatcagcgagagagacagactggagatctacgaggacgtgctgttcttcctgagcaagaaggagaaggagcaggccaagcagctgagaaagagaaactgggaggccctgaagaacatcctggacaacatggccaacgtgacctacagcaccacctggagcgaggcccagcagtacctgatggacaaccccaccttcgccgaggacgaggagctgcagaacatggacaaggaggacgccctgatctgcttcgaggagcacatcagagccctggagaaggaggaggaggaggagaagcagaagagcctgctgagagagagaagaagacagagaaagaacagagagagcttccagatcttcctggacgagctgcacgagcacggccagctgcacagcatgagcagctggatggagctgtaccccaccatcagcagcgacatcagattcaccaacatgctgggccagcccggcagcaccgccctggacctgttcaagttctacgtggaggacctgaaggccagataccacgacgagaagaagatcatcaaggacatcctgaaggacaagggcttcgtggtggaggtgaacaccaccttcgaggacttcgtggccatcatcagcagcaccaagagaagcaccaccctggacgccggcaacatcaagctggccttcaacagcctgctggagaaggccgaggccagagagagagagagagagaaggaggaggccagaaagatgaagagaaaggagagcgccttcaagagcatgctgaagcaggccgccccccccatcgagctggacgccgtgtgggaggacatcagagagagattcgtgaaggagcccgccttcgaggacatcaccctggagagcgagagaaagagaatcttcaaggacttcatgcacgtgctggagcacgagtgccagcaccaccacagcaagaacaagaagcacagcaagaagagcaagaagcaccacagaaagagaagcagaagcagaagcggcagcgacagcgacgacgacgacagccacagcaagaagaagagacagagaagcgagagcagaagcgccagcgagcacagcagcagcgccgagagcgagagaagctacaagaagagcaagaagcacaagaagaagagcaagaagagaagacacaagagcgacagccccgagagcgacgccgagagagagaaggacaagaaggagaaggacagagagagcgagaaggacagaaccagacagagaagcgagagcaagcacaagagccccaagaagaagaccggcaaggacagcggcaactgggacaccagcggcagcgagctgagcgagggcgagctggagaagagaagaagaaccctgctggagcagctggacgacgaccagtag

SEQ ID NO: 95809 - DNA, 2451 bp, Artificial Sequence
  Description of Artificial Sequence: Synthetic coding sequence
atgtgcagcggcagcggcagaagaagaagcagcctgagccccaccatgagacccggcaccggcgccgagagaggcggcctgatgatgggccaccccggcatgcactacgcccccatgggcatgcaccccatgggccagagagccaacatgccccccgtgccccacggcatgatgccccagatgatgccccccatgggcggcccccccatgggccagatgcccggcatgatgagcagcgtgatgcccggcatgatgatgagccacatgagccaggccagcatgcagcccgccctgccccagctgctgagcaagtgcccctggaaggagtacaagagcgacagcggcaagccctactactacaacagccagaccaaggagagcagatgggccaagcccaaggagctggaggacctggagggctaccagaacaccatcgtggccggcagcctgatcaccaagagcaacctgcacggcatgctgaccgagctgaagtacagcaagcaggaggagtgcaccaccaccagcaccgcccccgtgcccaccaccgagatccccaccaccatgagcaccatggccgccgccgaggccgccgccgccgtggtggccgccgccgccgccgccgccgccgccgccgccgccgccaacgccaacgccagcaccagcgccagcaacaccgtgagcggcaccgtgcccgtggtgcccgagcccgaggtgaccagcatcgtggccaccgtggtggacaacgagaacaccgtgaccatcagcaccgaggagcaggcccagctgaccagcacccccgccatccaggaccagagcgtggaggtgagcagcaacaccggcgaggagaccagcaagcaggagaccgtggccgacttcacccccaagaaggaggaggaggagagccagcccgccaagaagacctacacctggaacaccaaggaggaggccaagcaggccttcaaggagctgctgaaggagaagagagtgcccagcaacgccagctgggagcaggccatgaagatgatcatcaacgaccccagatacagcgccctggccaagctgagcgagaagaagcaggccttcaacgcctacaaggtgcagaccgagaaggaggagaaggaggaggccagaagcaagtacaaggaggccaaggagagcttccagagattcctggagaaccacgagaagatgaccagcaccaccagatacaagaaggccgagcagatgttcggcgagatggaggtgtggaacgccatcagcgagagagacagactggagatctacgaggacgtgctgttcttcctgagcaagaaggagaaggagcaggccaagcagctgagaaagagaaactgggaggccctgaagaacatcctggacaacatggccaacgtgacctacagcaccacctggagcgaggcccagcagtacctgatggacaaccccaccttcgccgaggacgaggagctgcagaacatggacaaggaggacgccctgatctgcttcgaggagcacatcagagccctggagaaggaggaggaggaggagaagcagaagagcctgctgagagagagaagaagacagagaaagaacagagagagcttccagatcttcctggacgagctgcacgagcacggccagctgcacagcatgagcagctggatggagctgtaccccaccatcagcagcgacatcagattcaccaacatgctgggccagcccgtgttcagcctgggcagcaccgccctggacctgttcaagttctacgtggaggacctgaaggccagataccacgacgagaagaagatcatcaaggacatcctgaaggacaagggcttcgtggtggaggtgaacaccaccttcgaggacttcgtggccatcatcagcagcaccaagagaagcaccaccctggacgccggcaacatcaagctggccttcaacagcctgctggagaaggccgaggccagagagagagagagagagaaggaggaggccagaaagatgaagagaaaggagagcgccttcaagagcatgctgaagcaggccgccccccccatcgagctggacgccgtgtgggaggacatcagagagagattcgtgaaggagcccgccttcgaggacatcaccctggagagcgagagaaagagaatcttcaaggacttcatgcacgtgctggagcacgagtgccagcaccaccacagcaagaacaagaagcacagcaagaagagcaagaagcaccacagaaagagaagcagaagcagaagcggcagcgacagcgacgacgacgacagccacagcaagaagaagagacagagaagcgagagcagaagcgccagcgagcacagcagcagcgccgagagcgagagaagctacaagaagagcaagaagcacaagaagaagagcaagaagagaagacacaagagcgacagccccgagagcgacgccgagagatag

SEQ ID NO: 95810 - DNA, 2793 bp, Artificial Sequence
  Description of Artificial Sequence: Synthetic coding sequence
atgtgcagcggcagcggcagaagaagaagcagcctgagccccaccatgagacccggcaccggcgccgagagaggcggcctgatgatgggccaccccggcatgcactacgcccccatgggcatgcaccccatgggccagagagccaacatgccccccgtgccccacggcatgatgccccagatgatgccccccatgggcggcccccccatgggccagatgcccggcatgatgagcagcgtgatgcccggcatgatgatgagccacatgagccaggccagcatgcagcccgccctgccccccggcgtgaacagcatggacgtggccgccggcaccgccagcggcgccaagagcatgtggaccgagcacaagagccccgacggcagaacctactactacaacaccgagaccaagcagagcacctgggagaagcccgacgacctgaagacccccgccgagcagctgctgagcaagtgcccctggaaggagtacaagagcgacagcggcaagccctactactacaacagccagaccaaggagagcagatgggccaagcccaaggagctggaggacctggagggctaccagaacaccatcgtggccggcagcctgatcaccaagagcaacctgcacgccatgatcaaggccgaggagagcagcaagcaggaggagtgcaccaccaccagcaccgcccccgtgcccaccaccgagatccccaccaccatgagcaccatggccgccgccgaggccgccgccgccgtggtggccgccgccgccgccgccgccgccgccgccgccgccgccaacgccaacgccagcaccagcgccagcaacaccgtgagcggcaccgtgcccgtggtgcccgagcccgaggtgaccagcatcgtggccaccgtggtggacaacgagaacaccgtgaccatcagcaccgaggagcaggcccagctgaccagcacccccgccatccaggaccagagcgtggaggtgagcagcaacaccggcgaggagaccagcaagcaggagaccgtggccgacttcacccccaagaaggaggaggaggagagccagcccgccaagaagacctacacctggaacaccaaggaggaggccaagcaggccttcaaggagctgctgaaggagaagagagtgcccagcaacgccagctgggagcaggccatgaagatgatcatcaacgaccccagatacagcgccctggccaagctgagcgagaagaagcaggccttcaacgcctacaaggtgcagaccgagaaggaggagaaggaggaggccagaagcaagtacaaggaggccaaggagagcttccagagattcctggagaaccacgagaagatgaccagcaccaccagatacaagaaggccgagcagatgttcggcgagatggaggtgtggaacgccatcagcgagagagacagactggagatctacgaggacgtgctgttcttcctgagcaagaaggagaaggagcaggccaagcagctgagaaagagaaactgggaggccctgaagaacatcctggacaacatggccaacgtgacctacagcaccacctggagcgaggcccagcagtacctgatggacaaccccaccttcgccgaggacgaggagctgcagaacatggacaaggaggacgccctgatctgcttcgaggagcacatcagagccctggagaaggaggaggaggaggagaagcagaagagcctgctgagagagagaagaagacagagaaagaacagagagagcttccagatcttcctggacgagctgcacgagcacggccagctgcacagcatgagcagctggatggagctgtaccccaccatcagcagcgacatcagattcaccaacatgctgggccagcccggcagcaccgccctggacctgttcaagttctacgtggaggacctgaaggccagataccacgacgagaagaagatcatcaaggacatcctgaaggacaagggcttcgtggtggaggtgaacaccaccttcgaggacttcgtggccatcatcagcagcaccaagagaagcaccaccctggacgccggcaacatcaagctggccttcaacagcctgctggagaaggccgaggccagagagagagagagagagaaggaggaggccagaaagatgaagagaaaggagagcgccttcaagagcatgctgaagcaggccgccccccccatcgagctggacgccgtgtgggaggacatcagagagagattcgtgaaggagcccgccttcgaggacatcaccctggagagcgagagaaagagaatcttcaaggacttcatgcacgtgctggagcacgagtgccagcaccaccacagcaagaacaagaagcacagcaagaagagcaagaagcaccacagaaagagaagcagaagcagaagcggcagcgacagcgacgacgacgacagccacagcaagaagaagagacagagaagcgagagcagaagcgccagcgagcacagcagcagcgccgagagcgagagaagctacaagaagagcaagaagcacaagaagaagagcaagaagagaagacacaagagcgacagccccgagagcgacgccgagagagagaaggacaagaaggagaaggacagagagagcgagaaggacagaaccagacagagaagcgagagcaagcacaagagccccaagaagaagaccggcaaggacagcggcaactgggacaccagcggcagcgagctgagcgagggcgagctggagaagagaagaagaaccctgctggagcagctggacgacgaccagtag

SEQ ID NO: 95811 - DNA, 2481 bp, Artificial Sequence
  Description of Artificial Sequence: Synthetic coding sequence
atggacgtggccgccggcaccgccagcggcgccaagagcatgtggaccgagcacaagagccccgacggcagaacctactactacaacaccgagaccaagcagagcacctgggagaagcccgacgacctgaagacccccgccgagcagctgctgagcaagtgcccctggaaggagtacaagagcgacagcggcaagccctactactacaacagccagaccaaggagagcagatgggccaagcccaaggagctggaggacctggagggctaccagaacaccatcgtggccggcagcctgatcaccaagagcaacctgcacggcatgctgaccgagctgaagtacagcaagcaggaggagtgcaccaccaccagcaccgcccccgtgcccaccaccgagatccccaccaccatgagcaccatggccgccgccgaggccgccgccgccgtggtggccgccgccgccgccgccgccgccgccgccgccgccgccaacgccaacgccagcaccagcgccagcaacaccgtgagcggcaccgtgcccgtggtgcccgagcccgaggtgaccagcatcgtggccaccgtggtggacaacgagaacaccgtgaccatcagcaccgaggagcaggcccagctgaccagcacccccgccatccaggaccagagcgtggaggtgagcagcaacaccggcgaggagaccagcaagcaggagaccgtggccgacttcacccccaagaaggaggaggaggagagccagcccgccaagaagacctacacctggaacaccaaggaggaggccaagcaggccttcaaggagctgctgaaggagaagagagtgcccagcaacgccagctgggagcaggccatgaagatgatcatcaacgaccccagatacagcgccctggccaagctgagcgagaagaagcaggccttcaacgcctacaaggtgcagaccgagaaggaggagaaggaggaggccagaagcaagtacaaggaggccaaggagagcttccagagattcctggagaaccacgagaagatgaccagcaccaccagatacaagaaggccgagcagatgttcggcgagatggaggtgtggaacgccatcagcgagagagacagactggagatctacgaggacgtgctgttcttcctgagcaagaaggagaaggagcaggccaagcagctgagaaagagaaactgggaggccctgaagaacatcctggacaacatggccaacgtgacctacagcaccacctggagcgaggcccagcagtacctgatggacaaccccaccttcgccgaggacgaggagctgcagaacatggacaaggaggacgccctgatctgcttcgaggagcacatcagagccctggagaaggaggaggaggaggagaagcagaagagcctgctgagagagagaagaagacagagaaagaacagagagagcttccagatcttcctggacgagctgcacgagcacggccagctgcacagcatgagcagctggatggagctgtaccccaccatcagcagcgacatcagattcaccaacatgctgggccagcccggcagcaccgccctggacctgttcaagttctacgtggaggacctgaaggccagataccacgacgagaagaagatcatcaaggacatcctgaaggacaagggcttcgtggtggaggtgaacaccaccttcgaggacttcgtggccatcatcagcagcaccaagagaagcaccaccctggacgccggcaacatcaagctggccttcaacagcctgctggagaaggccgaggccagagagagagagagagagaaggaggaggccagaaagatgaagagaaaggagagcgccttcaagagcatgctgaagcaggccgccccccccatcgagctggacgccgtgtgggaggacatcagagagagattcgtgaaggagcccgccttcgaggacatcaccctggagagcgagagaaagagaatcttcaaggacttcatgcacgtgctggagcacgagtgccagcaccaccacagcaagaacaagaagcacagcaagaagagcaagaagcaccacagaaagagaagcagaagcagaagcggcagcgacagcgacgacgacgacagccacagcaagaagaagagacagagaagcgagagcagaagcgccagcgagcacagcagcagcgccgagagcgagagaagctacaagaagagcaagaagcacaagaagaagagcaagaagagaagacacaagagcgacagccccgagagcgacgccgagagagagaaggacaagaaggagaaggacagagagagcgagaaggacagaaccagacagagaagcgagagcaagcacaagagccccaagaagaagaccggcaaggacagcggcaactgggacaccagcggcagcgagctgagcgagggcgagctggagaagagaagaagaaccctgctggagcagctggacgacgaccagtag

SEQ ID NO: 95812 - DNA, 1347 bp, Artificial Sequence
  Description of Artificial Sequence: Synthetic coding sequence
atgagacccggcaccggcgccgagagaggcggcctgatggtgagcgagatggagagccacccccccagccagggccccggcgacggcgagagaagactgagcggcagcagcctgtgcagcggcagctgggtgagcgccgacggcttcctgagaagaagacccagcatgggccaccccggcatgcactacgcccccatgggcatgcaccccatgggccagagagccaacatgccccccgtgccccacggcatgatgccccagatgatgccccccatgggcggcccccccatgggccagatgcccggcatgatgagcagcgtgatgcccggcatgatgatgagccacatgagccaggccagcatgcagcccgccctgccccccggcgtgaacagcatggacgtggccgccggcaccgccagcggcgccaagagcatgtggaccgagcacaagagccccgacggcagaacctactactacaacaccgagaccaagcagagcacctgggagaagcccgacgacctgaagacccccgccgagcagctgctgagcaagtgcccctggaaggagtacaagagcgacagcggcaagccctactactacaacagccagaccaaggagagcagatgggccaagcccaaggagctggaggacctggagggctaccagaacaccatcgtggccggcagcctgatcaccaagagcaacctgcacgccatgatcaaggccgaggagagcagcaagcaggaggagtgcaccaccaccagcaccgcccccgtgcccaccaccgagatccccaccaccatgagcaccatggccgccgccgaggccgccgccgccgtggtggccgccgccgccgccgccgccgccgccgccgccgccgccaacgccaacgccagcaccagcgccagcaacaccgtgagcggcaccgtgcccgtggtgcccgagcccgaggtgaccagcatcgtggccaccgtggtggacaacgagaacaccgtgaccatcagcaccgaggagcaggcccagctgaccagcacccccgccatccaggaccagagcgtggaggtgagcagcaacaccggcgaggagaccagcaagcaggagaccgtggccgacttcacccccaagaaggaggaggaggagagccagcccgccaagaagacctacacctggaacaccaaggaggaggccaagcaggccttcaaggagctgctgaaggagaagagagtgcccagcaacgccagctgggagcaggccatgaagatgatcatcaacgaccccagatacagcgccctggccaagctgagcgagaagaagcaggccttcaacgcctacaaggtgcagacctag

SEQ ID NO: 95813 - DNA, 2826 bp, Artificial Sequence
  Description of Artificial Sequence: Synthetic coding sequence
atgaacaagaagaagaagcccttcctgggcatgcccgcccccctgggctacgtgcccggcctgggcagaggcgccaccggcttcaccaccagaagcgacatcggccccgccagagacgccaacgaccccgtggacgacagacacgccccccccggcaagagaaccgtgggcgaccagatgaagaagaaccaggccgccgacgacgacgacgaggacctgaacgacaccaactacgacgagttcaacggctacgccggcagcctgttcagcagcggcccctacgagaaggacgacgaggaggccgacgccatctacgccgccctggacaagagaatggacgagagaagaaaggagagaagagagcagagagagaaggaggagatcgagaagtacagaatggagagacccaagatccagcagcagttcagcgacctgaagagaaagctggccgaggtgaccgaggaggagtggctgagcatccccgaggtgggcgacgccagaaacaagagacagagaaaccccagatacgagaagctgacccccgtgcccgacagcttcttcgccaagcacctgcagaccggcgagaaccacaccagcgtggaccccagacagacccagttcggcggcctgaacaccccctaccccggcggcctgaacaccccctaccccggcggcatgacccccggcctgatgacccccggcaccggcgagctggacatgagaaagatcggccaggccagaaacaccctgatggacatgagactgagccaggtgagcgacagcgtgagcggccagaccgtggtggaccccaagggctacctgaccgacctgaacagcatgatccccacccacggcggcgacatcaacgacatcaagaaggccagactgctgctgaagagcgtgagagagaccaacccccaccacccccccgcctggatcgccagcgccagactggaggaggtgaccggcaagctgcaggtggccagaaacctgatcatgaagggcaccgagatgtgccccaagagcgaggacgtgtggctggaggccgccagactgcagcccggcgacaccgccaaggccgtggtggcccaggccgtgagacacctgccccagagcgtgagaatctacatcagagccgccgagctggagaccgacatcagagccaagaagagagtgctgagaaaggccctggagcacgtgcccaacagcgtgagactgtggaaggccgccgtggagctggaggagcccgaggacgccagaatcatgctgagcagagccgtggagtgctgccccaccagcgtggagctgtggctggccctggccagactggagacctacgagaacgccagaaaggtgctgaacaaggccagagagaacatccccaccgacagacacatctggatcaccgccgccaagctggaggaggccaacggcaacacccagatggtggagaagatcatcgacagagccatcaccagcctgagagccaacggcgtggagatcaacagagagcagtggatccaggacgccgaggagtgcgacagagccggcagcgtggccacctgccaggccgtgatgagagccgtgatcggcatcggcatcgaggaggaggacagaaagcacacctggatggaggacgccgacagctgcgtggcccacaacgccctggagtgcgccagagccatctacgcctacgccctgcaggtgttccccagcaagaagagcgtgtggctgagagccgcctacttcgagaagaaccacggcaccagagagagcctggaggccctgctgcagagagccgtggcccactgccccaaggccgaggtgctgtggctgatgggcgccaagagcaagtggctggccggcgacgtgcccgccgccagaagcatcctggccctggccttccaggccaaccccaacagcgaggagatctggctggccgccgtgaagctggagagcgagaacgacgagtacgagagagccagaagactgctggccaaggccagaagcagcgcccccaccgccagagtgttcatgaagagcgtgaagctggagtgggtgcaggacaacatcagagccgcccaggacctgtgcgaggaggccctgagacactacgaggacttccccaagctgtggatgatgaagggccagatcgaggagcagaaggagatgatggagaaggccagagaggcctacaaccagggcctgaagaagtgcccccacagcacccccctgtggctgctgctgagcagactggaggagaagatcggccagctgaccagagccagagccatcctggagaagagcagactgaagaaccccaagaaccccggcctgtggctggagagcgtgagactggagtacagagccggcctgaagaacatcgccaacaccctgatggccaaggccctgcaggagtgccccaacagcggcatcctgtggagcgaggccatcttcctggaggccagaccccagagaagaaccaagagcgtggacgccctgaagaagtgcgagcacgacccccacgtgctgctggccgtggccaagctgttctggagccagagaaagatcaccaaggccagagagtggttccacagaaccgtgaagatcgacagcgacctgggcgacgcctgggccttcttctacaagttcgagctgcagcacggcaccgaggagcagcaggaggaggtgagaaagagatgcgagagcgccgagcccagacacggcgagctgtggtgcgccgtgagcaaggacatcgccaactggcagaagaagatcggcgacatcctgagactggtggccggcagaatcaagaacaccttctag

SEQ ID NO: 95814 - DNA, 2706 bp, Artificial Sequence
  Description of Artificial Sequence: Synthetic coding sequence
atgaacaagaagaagaagcccttcctgggcatgcccgcccccctgggctacgtgcccggcctgggcagaggcgccaccggcttcaccaccagaagcgacatcggccccgccagagacgccaacgaccccgtggacgacagacacgccccccccggcaagagaaccgtgggcgaccagatgaagaagaaccaggccgccgacgacgacgacgaggacctgaacgacaccaactacgacgagttcaacggctacgccggcagcctgttcagcagcggcccctacgagaaggacgacgaggaggccgacgccatctacgccgccctggacaagagaatggacgagagaagaaaggagagaagagagcagagagagaaggaggagatcgagaagtacagaatggagagacccaagatccagcagcagttcagcgacctgaagagaaagctggccgaggtgaccgaggaggagtggctgagcatccccgaggtgggcgacgccagaaacaagagacagagaaaccccagatacgagaagctgacccccgtgcccgacagcttcttcgccaagcacctgcagaccggcgagaaccacaccagcgtggaccccagacagacccagttcggcggcctgaacaccccctaccccggcggcctgaacaccccctaccccggcggcatgacccccggcctgatgacccccggcaccggcgagctggacatgagaaagatcggccaggccagaaacaccctgatggacatgagactgagccaggtgagcgacagcgtgagcggccagaccgtggtggaccccaagggctacctgaccgacctgaacagcatgatccccacccacggcggcgacatcaacgacatcaagaaggccagactgctgctgaagagcgtgagagagaccaacccccaccacccccccgcctggatcgccagcgccagactggaggaggtgaccggcaagctgcaggtggccagaaacctgatcatgaagggcaccgagatgtgccccaagagcgaggacgtgtggctggaggccgccagactgcagcccggcgacaccgccaaggccgtggtggcccaggccgtgagacacctgccccagagcgtgagaatctacatcagagccgccgagctggagaccgacatcagagccaagaagagagtgctgagaaaggccctggagcacgtgcccaacagcgtgagactgtggaaggccgccgtggagctggaggagcccgaggacgccagaatcatgctgagcagagccgtggagtgctgccccaccagcgtggagctgtggctggccctggccagactggagacctacgagaacgccagaaaggtgctgaacaaggccagagagaacatccccaccgacagacacatctggatcaccgccgccaagctggaggaggccaacggcaacacccagatggtggagaagatcatcgacagagccatcaccagcctgagagccaacggcgtggagatcaacagagagcagtggatccaggacgccgaggagtgcgacagagccggcagcgtggccacctgccaggccgtgatgagagccgtgatcggcatcggcatcgaggaggaggacagaaagcacacctggatggaggacgccgacagctgcgtggcccacaacgccctggagtgcgccagagccatctacgcctacgccctgcaggtgttccccagcaagaagagcgtgtggctgagagccgcctacttcgagaagaaccacggcaccagagagagcctggaggccctgctgcagagagccgtggcccactgccccaaggccgaggtgctgtggctgatgggcgccaagagcaagtggctggccggcgacgtgcccgccgccagaagcatcctggccctggccttccaggtgttcatgaagagcgtgaagctggagtgggtgcaggacaacatcagagccgcccaggacctgtgcgaggaggccctgagacactacgaggacttccccaagctgtggatgatgaagggccagatcgaggagcagaaggagatgatggagaaggccagagaggcctacaaccagggcctgaagaagtgcccccacagcacccccctgtggctgctgctgagcagactggaggagaagatcggccagctgaccagagccagagccatcctggagaagagcagactgaagaaccccaagaaccccggcctgtggctggagagcgtgagactggagtacagagccggcctgaagaacatcgccaacaccctgatggccaaggccctgcaggagtgccccaacagcggcatcctgtggagcgaggccatcttcctggaggccagaccccagagaagaaccaagagcgtggacgccctgaagaagtgcgagcacgacccccacgtgctgctggccgtggccaagctgttctggagccagagaaagatcaccaaggccagagagtggttccacagaaccgtgaagatcgacagcgacctgggcgacgcctgggccttcttctacaagttcgagctgcagcacggcaccgaggagcagcaggaggaggtgagaaagagatgcgagagcgccgagcccagacacggcgagctgtggtgcgccgtgagcaaggacatcgccaactggcagaagaagatcggcgacatcctgagactggtggccggcagaatcaagaacaccttctag

SEQ ID NO: 95815 - DNA, 7008 bp, Artificial Sequence
  Description of Artificial Sequence: Synthetic coding sequence
atggccggcgtgttcccctacagaggccccggcaaccccgtgcccggccccctggcccccctgcccgactacatgagcgaggagaagctgcaggagaaggccagaaagtggcagcagctgcaggccaagagatacgccgagaagagaaagttcggcttcgtggacgcccagaaggaggacatgccccccgagcacgtgagaaagatcatcagagaccacggcgacatgaccaacagaaagttcagacacgacaagagagtgtacctgggcgccctgaagtacatgccccacgccgtgctgaagctgctggagaacatgcccatgccctgggagcagatcagagacgtgcccgtgctgtaccacatcaccggcgccatcagcttcgtgaacgagatcccctgggtgatcgagcccgtgtacatcagccagtggggcagcatgtggatcatgatgagaagagagaagagagacagaagacacttcaagagaatgagattcccccccttcgacgacgaggagccccccctggactacgccgacaacatcctggacgtggagcccctggaggccatccagctggagctggaccccgaggaggacgcccccgtgctggactggttctacgaccaccagcccctgagagacagcagaaagtacgtgaacggcagcacctaccagagatggcagttcaccctgcccatgatgagcaccctgtacagactggccaaccagctgctgaccgacctggtggacgacaactacttctacctgttcgacctgaaggccttcttcaccagcaaggccctgaacatggccatccccggcggccccaagttcgagcccctggtgagagacatcaacctgcaggacgaggactggaacgagttcaacgacatcaacaagatcatcatcagacagcccatcagaaccgagtacaagatcgccttcccctacctgtacaacaacctgccccaccacgtgcacctgacctggtaccacacccccaacgtggtgttcatcaagaccgaggaccccgacctgcccgccttctacttcgaccccctgatcaaccccatcagccacagacacagcgtgaagagccaggagcccctgcccgacgacgacgaggagttcgagctgcccgagttcgtggagcccttcctgaaggacacccccctgtacaccgacaacaccgccaacggcatcgccctgctgtgggcccccagacccttcaacctgagaagcggcagaaccagaagagccctggacatccccctggtgaagaactggtacagagagcactgccccgccggccagcccgtgaaggtgagagtgagctaccagaagctgctgaagtactacgtgctgaacgccctgaagcacagaccccccaaggcccagaagaagagatacctgttcagaagcttcaaggccaccaagttcttccagagcaccaagctggactgggtggaggtgggcctgcaggtgtgcagacagggctacaacatgctgaacctgctgatccacagaaagaacctgaactacctgcacctggactacaacttcaacctgaagcccgtgaagaccctgaccaccaaggagagaaagaagagcagattcggcaacgccttccacctgtgcagagaggtgctgagactgaccaagctggtggtggacagccacgtgcagtacagactgggcaacgtggacgccttccagctggccgacggcctgcagtacatcttcgcccacgtgggccagctgaccggcatgtacagatacaagtacaagctgatgagacagatcagaatgtgcaaggacctgaagcacctgatctactacagattcaacaccggccccgtgggcaagggccccggctgcggcttctgggccgccggctggagagtgtggctgttcttcatgagaggcatcacccccctgctggagagatggctgggcaacctgctggccagacagttcgagggcagacacagcaagggcgtggccaagaccgtgaccaagcagagagtggagagccacttcgacctggagctgagagccgccgtgatgcacgacatcctggacatgatgcccgagggcatcaagcagaacaaggccagaaccatcctgcagcacctgagcgaggcctggagatgctggaaggccaacatcccctggaaggtgcccggcctgcccacccccatcgagaacatgatcctgagatacgtgaaggccaaggccgactggtggaccaacaccgcccactacaacagagagagaatcagaagaggcgccaccgtggacaagaccgtgtgcaagaagaacctgggcagactgaccagactgtacctgaaggccgagcaggagagacagcacaactacctgaaggacggcccctacatcaccgccgaggaggccgtggccgtgtacaccaccaccgtgcactggctggagagcagaagattcagccccatccccttcccccccctgagctacaagcacgacaccaagctgctgatcctggccctggagagactgaaggaggcctacagcgtgaagagcagactgaaccagagccagagagaggagctgggcctgatcgagcaggcctacgacaacccccacgaggccctgagcagaatcaagagacacctgctgacccagagagccttcaaggaggtgggcatcgagttcatggacctgtacagccacctggtgcccgtgtacgacgtggagcccctggagaagatcaccgacgcctacctggaccagtacctgtggtacgaggccgacaagagaagactgttccccccctggatcaagcccgccgacaccgagcccccccccctgctggtgtacaagtggtgccagggcatcaacaacctgcaggacgtgtgggagaccagcgagggcgagtgcaacgtgatgctggagagcagattcgagaagatgtacgagaagatcgacctgaccctgctgaacagactgctgagactgatcgtggaccacaacatcgccgactacatgaccgccaagaacaacgtggtgatcaactacaaggacatgaaccacaccaacagctacggcatcatcagaggcctgcagttcgccagcttcatcgtgcagtactacggcctggtgatggacctgctggtgctgggcctgcacagagccagcgagatggccggccccccccagatgcccaacgacttcctgagcttccaggacatcgccaccgaggccgcccaccccatcagactgttctgcagatacatcgacagaatccacatcttcttcagattcaccgccgacgaggccagagacctgatccagagatacctgaccgagcaccccgaccccaacaacgagaacatcgtgggctacaacaacaagaagtgctggcccagagacgccagaatgagactgatgaagcacgacgtgaacctgggcagagccgtgttctgggacatcaagaacagactgcccagaagcgtgaccaccgtgcagtgggagaacagcttcgtgagcgtgtacagcaaggacaaccccaacctgctgttcaacatgtgcggcttcgagtgcagaatcctgcccaagtgcagaaccagctacgaggagttcacccacaaggacggcgtgtggaacctgcagaacgaggtgaccaaggagagaaccgcccagtgcttcctgagagtggacgacgagagcatgcagagattccacaacagagtgagacagatcctgatggccagcggcagcaccaccttcaccaagatcgtgaacaagtggaacaccgccctgatcggcctgatgacctacttcagagaggccgtggtgaacacccaggagctgctggacctgctggtgaagtgcgagaacaagatccagaccagaatcaagatcggcctgaacagcaagatgcccagcagattcccccccgtggtgttctacacccccaaggagctgggcggcctgggcatgctgagcatgggccacgtgctgatcccccagagcgacctgagatggagcaagcagaccgacgtgggcatcacccacttcagaagcggcatgagccacgaggaggaccagctgatccccaacctgtacagatacatccagccctgggagagcgagttcatcgacagccagagagtgtgggccgagtacgccctgaagagacaggaggccatcgcccagaacagaagactgaccctggaggacctggaggacagctgggacagaggcatccccagaatcaacaccctgttccagaaggacagacacaccctggcctacgacaagggctggagagtgagaaccgacttcaagcagtaccaggtgctgaagcagaaccccttctggtggacccaccagagacacgacggcaagctgtggaacctgaacaactacagaaccgacatgatccaggccctgggcggcgtggagggcatcctggagcacaccctgttcaagggcacctacttccccacctgggagggcctgttctgggagaaggccagcggcttcgaggagagcatgaagtggaagaagctgaccaacgcccagagaagcggcctgaaccagatccccaacagaagattcaccctgtggtggagccccaccatcaacagagccaacgtgtacgtgggcttccaggtgcagctggacctgaccggcatcttcatgcacggcaagatccccaccctgaagatcagcctgatccagatcttcagagcccacctgtggcagaagatccacgagagcatcgtgatggacctgtgccaggtgttcgaccaggagctggacgccctggagatcgagaccgtgcagaaggagaccatccaccccagaaagagctacaagatgaacagcagctgcgccgacatcctgctgttcgccagctacaagtggaacgtgagcagacccagcctgctggccgacagcaaggacgtgatggacagcaccaccacccagaagtactggatcgacatccagctgagatggggcgactacgacagccacgacatcgagagatacgccagagccaagttcctggactacaccaccgacaacatgagcatctaccccagccccaccggcgtgctgatcgccatcgacctggcctacaacctgcacagcgcctacggcaactggttccccggcagcaagcccctgatccagcaggccatggccaagatcatgaaggccaaccccgccctgtacgtgctgagagagagaatcagaaagggcctgcagctgtacagcagcgagcccaccgagccctacctgagcagccagaactacggcgagctgttcagcaaccagatcatctggttcgtggacgacaccaacgtgtacagagtgaccatccacaagaccttcgagggcaacctgaccaccaagcccatcaacggcgccatcttcatcttcaaccccagaaccggccagctgttcctgaagatcatccacaccagcgtgtgggccggccagaagagactgggccagctggccaagtggaagaccgccgaggaggtggccgccctgatcagaagcctgcccgtggaggagcagcccaagcagatcatcgtgaccagaaagggcatgctggaccccctggaggtgcacctgctggacttccccaacatcgtgatcaagggcagcgagctgcagctgcccttccaggcctgcctgaaggtggagaagttcggcgacctgatcctgaaggccaccgagccccagatggtgctgttcaacctgtacgacgactggctgaagaccatcagcagctacaccgccttcagcagactgatcctgatcctgagagccctgcacgtgaacaacgacagagccaaggtgatcctgaagcccgacaagaccaccatcaccgagccccaccacatctggcccaccctgaccgacgaggagtggatcaaggtggaggtgcagctgaaggacctgatcctggccgactacggcaagaagaacaacgtgaacgtggccagcctgacccagagcgagatcagagacatcatcctgggcatggagatcagcgcccccagccagcagagacagcagatcgccgagatcgagaagcagaccaaggagcagagccagctgaccgccacccagaccagaaccgtgaacaagcacggcgacgagatcatcaccagcaccaccagcaactacgagacccagaccttcagcagcaagaccgagtggagagtgagagccatcagcgccgccaacctgcacctgagaaccaaccacatctacgtgagcagcgacgacatcaaggagaccggctacacctacatcctgcccaagaacgtgctgaagaagttcatctgcatcagcgacctgagagcccagatcgccggctacctgtacggcgtgagcccccccgacaacccccaggtgaaggagatcagatgcatcgtgatggtgccccagtggggcacccaccagaccgtgcacctgcccggccagctgccccagcacgagtacctgaaggagatggagcccctgggctggatccacacccagcccaacgagagcccccagctgagcccccaggacgtgaccacccacgccaagatcatggccgacaaccccagctgggacggcgagaagaccatcatcatcacctgcagcttcacccccggcagctgcaccctgaccgcctacaagctgacccccagcggctacgagtggggcagacagaacaccgacaagggcaacaaccccaagggctacctgcccagccactacgagagagtgcagatgctgctgagcgacagattcctgggcttcttcatggtgcccgcccagagcagctggaactacaacttcatgggcgtgagacacgaccccaacatgaagtacgagctgcagctggccaaccccaaggagttctaccacgaggtgcacagacccagccacttcctgaacttcgccctgctgcaggagggcgaggtgtacagcgccgacagagaggacctgtacgcctag

SEQ ID NO: 95816 - DNA, 1392 bp, Artificial Sequence
  Description of Artificial Sequence: Synthetic coding sequence
atgatccaggccctgggcggcgtggagggcatcctggagcacaccctgttcaagggcacctacttccccacctgggagggcctgttctgggagaaggccagcggcttcgaggagagcatgaagtggaagaagctgaccaacgcccagagaagcggcctgaaccagatccccaacagaagattcaccctgtggtggagccccaccatcaacagagccaacgtgtacgtgggcttccaggtgcagctggacctgaccggcatcttcatgcacggcaagatccccaccctgaagatcagcctgatccagatcttcagagcccacctgtggcagaagatccacgagagcatcgtgatggacctgtgccaggtgttcgaccaggagctggacgccctggagatcgagaccgtgcagaaggagaccatccaccccagaaagagctacaagatgaacagcagctgcgccgacatcctgctgttcgccagctacaagtggaacgtgagcagacccagcctgctggccgacagcaaggacgtgatggacagcaccaccacccagaagtactggatcgacatccagctgagatggggcgactacgacagccacgacatcgagagatacgccagagccaagttcctggactacaccaccgacaacatgagcatctaccccagccccaccggcgtgctgatcgccatcgacctggcctacaacctgcacagctacagcgaggtgggcagcctgcagcaggccagccacaccaccggcgccaagatcatgaaggccaaccccgccctgtacgtgctgagagagagaatcagaaagggcctgcagctgtacagcagcgagcccaccgagccctacctgagcagccagaactacggcgagctgttcagcaaccagatcatctggttcgtggacgacaccaacgtgtacagagtgaccatccacaagaccttcgagggcaacctgaccaccaagcccatcaacggcgccatcttcatcttcaaccccagaaccggccagctgttcctgaagatcatccacaccagcgtgtgggccggccagaagagactgggccagctggccaagtggaagaccgccgaggaggtggccgccctgatcagaagcctgcccgtggaggagcagcccaagcagatcatcgtgaccagaaagggcatgctggaccccctggaggtgcacctgctggacttccccaacatcgtgatcaagggcagcgagctgcagctgcccttccaggcctgcctgaaggtggagaagttcggcgacctgatcctgaaggccaccgagccccagatggtgctgttcaacctgtacgacgactggctgaagaccatcagcagctacaccgccttcagcagactgatcctgtag

SEQ ID NO: 95817 - DNA, 2727 bp, Artificial Sequence
  Description of Artificial Sequence: Synthetic coding sequence
atggccgacggcggcggccccaaggacgcccccagcctgagaagcagccccggccccgcccccagagtgcccagagccgtgggccccagcggcggcggcggcgagacccccagaaccgccgccctggccctgagattcgacaagcccatcaagcaggccttctacaacaccggcgccgtgctgttcgtgtgcctgtgctgcggcgccgccgtgctggtgtacttcatcctggaggccttcctgagacccctgctgtgggccgtgctgtgcggcaccttcctgcaccccttcaagagcagcctgaccagactgggcagacactggctgcagagactgcacagagcccacacccccatcgtgctggccgccctgctgctgcccctgtgcttcgtggactacggcgtggaggccctgggcgagcaggccctgagaagaagaagactgctgctgctgctgggcgccggcggccccctgctgtacggcctgtactgcctgggcagctacctgggcgtgcaggtgctgctggtgcacgccgccaccctgatctgcagaggcctggactacttcagcagcctgtggatctggaccctggtggtgggctacgtgctgaccgtgagcttcaagtggaacgccagcaccgagagatacctgagagccgtgagcatccccgtgtggatcatcctgctgttccacctggccagcctggccggcagctggagaatccccgtgttcctggtgatcgtgttcctgatgagcgtgggcaccctgtacgagaagcagaacggcaaggagagcagcggcgccgagctgcccggccaggtgatcagcatggccgccagcaccctggccaacctggccatcagcatcaccggctacgagagcagcagcgaggaccagcccagcacccagcccgccgaggccgtggacagaggcgagagcgcccccaccctgagcaccagccccagccccagcagccccagccccaccagccccagccccaccctgggcagaagaagacccgagatcggcaccttcctgagaaagaagaagaccagcgacatctacttcgtgagcctggtgtgggccatcgtggtgatgcagatctggctgaacctgtggatcgtgcagctgctgcccgtgcccatcgccgtgtggatcctgaagaagctggtgatccacttcggcgtggtggacttcctggagaagagataccacgtgtggtggggcatcatcgagagcttcctgaaggagagacagggcgccctggccccctggcccatcgtgggcctgggcaagttcctgctgaaggtggacagcaagctgtggcactggctgaacaagaagatgatcatctggctggagaagatgctggacaagatcatcagcatcttcatcatcttcctgctggtgatcggcaccctgctgctggccctgctgctgaccgccaaggtgcaccaggagagcgtgcacatgatcgaggtgaccagcaacctgatcaacgagaccctggccaaccaccccgagtgggccaactggctgcccgaggcccaggtggtgcagagagccctgaacagcgccgccaacaacgtgtaccagtacggcagagagtggatcacccacaagctgcacaagatcctgggcgacaaggtgaacaacaccgccgtgatcgagaagcaggtgctggagctgtgggacagactgtaccacagctggttcgtgaagaacgtgacccacagcggcagacacaagggccagaagctgcacgtgagcagacagaacagctggctgggcgacatcctggactggcaggacatcgtgagcttcgtgcacgagaacatcgagaccttcctgagcatcctggagagcctgtggatcgtgatgagcagaaacgtgagcctgctgttcaccaccgtgaccaccctgctgaccatcctgttctacagcggcaccgccctgctgaacttcgtgctgagcctgatcatcttcctgaccaccctgttctacctgctgagcagcagcgacgagtactacaagcccgtgaagtgggtgatcagcctgacccccctgagccagcccggccccagcagcaacatcatcggccagagcgtggaggaggccatcagaggcgtgttcgacgccagcctgaagatggccggcttctacggcctgtacacctggctgacccacaccatgttcggcatcaacatcgtgttcatccccagcgccctggccgccatcctgggcgccgtgcccttcctgggcacctactgggccgccgtgcccgccgtgctggacctgtggctgacccagggcctgggctgcaaggccatcctgctgctgatcttccacctgctgcccacctacttcgtggacaccgccatctacagcgacatcagcggcggcggccacccctacctgaccggcctggccgtggccggcggcgcctactacctgggcctggagggcgccatcatcggccccatcctgctgtgcatcctggtggtggccagcaacatctacagcgccatgctggtgagccccaccaacagcgtgcccacccccaaccagaccccctggcccgcccagccccagagaaccttcagagacatcagcagaagcgagatcttcagcgtggacgtggtgagcagcgccgtgatcttcagaaagttcaagttcgacagcgagttcagcagcgccgtggccctgtgccccagcagctgcgcctag

SEQ ID NO: 95818 - DNA, 1062 bp, Artificial Sequence
  Description of Artificial Sequence: Synthetic coding sequence
atgctgaagagctgcagcagagccagcttcagccccagcgtgagaaagccccccctgatcctgagaagactgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaggaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagctggacgaggagctgagagaggccagcgaggccgccaagaccagctgcctgtacaacgaccccgagatgagcagcatggagaaggacatcgacctgaagctgaaggagaagccctag

SEQ ID NO: 95819 - DNA, 9267 bp, Artificial Sequence
  Description of Artificial Sequence: Synthetic coding sequence
atggaggagttcctgcagagagccaagagcaagctgaacagaagcaagagactggagaaggtgcacgtggtgatcggccccaagagctgcgacctggacagcctgatcagcaccttcacctacgcctacttcctggacaaggtgagcccccccggcgtgctgtgcctgcccgtgctgaacatccccagaaccgagttcaactacttcaccgagaccagattcatcctggaggagctgaacatcagcgagagcttccacatcttcagagacgagatcaacctgcaccagctgaacgacgagggcaagctgagcatcaccctggtgggcagcagcgtgctggccagcgaggacaagaccctggagagcgccgtggtgaaggtgatcaaccccgtggagcagagcgacgccaacgtggagttcagagagagcagcagcagcctggtgctgaaggagatcctgcaggaggcccccgagctgatcaccgagcagctggcccacagactgagaggcagcatcctgttcaagtggatgaccatggagagcgagaagatcagcgagaagcaggaggagatcctgagcatcctggaggagaagttccccaacctgccccccagagaggacatcatcaacgtgctgcaggagacccagttcagcgcccagggcctgagcatcgagcagaccatgctgaaggacctgaaggagctgagcgacggcgagatcaaggtggccatcagcaccgtgagcatgaacctggagaactgcctgttccacagcaacatcaccagcgacctgaaggccttcaccgacaagttcggcttcgacgtgctgatcctgttcagcagctacctgagcgaggagcagcagcccagaagacagatcgccgtgtacagcgagaacatggagctgtgcagccagatctgctgcgagctggaggagtgccagaacccctgcctggagctggagcccttcgactgcggctgcgacgagatcctggtgtaccagcaggaggaccccagcgtgacctgcgaccaggtggtgctggtggtgaaggaggtgatcaacagaagatgccccgagatggtgagcaacagcagaaccagcagcaccgaggccgtggccggcagcgcccccctgagccagggcagcagcggcatcatggagctgtacggcagcgacatcgagccccagcccagcagcgtgaacttcatcgagaacccccccgacctgaacgacagcaaccaggcccaggtggacgccaacgtggacctggtgagccccgacagcggcctggccaccatcagaagcagcagaagcagcaaggagagcagcgtgttcctgagcgacgacagccccgtgggcgagggcgccggcccccaccacaccctgctgcccggcctggacagctacagccccatccccgagggcgccgtggccgaggagcacgcctggagcggcgagcacggcgagcacttcgacctgttcaacttcgaccccgcccccatggccagcggccagagccagcagagcagccacagcgccgactacagccccgccgacgacttcttccccaacagcgacctgagcgagggccagctgcccgccggccccgagggcctggacggcatgggcaccaacatgagcaactacagcagcagcagcctgctgagcggcgccggcaaggacagcctggtggagcacgacgaggagttcgtgcagagacaggacagccccagagacaacagcgagagaaacctgagcctgaccgacttcgtgggcgacgagagccccagccccgagagactgaagaacaccggcaagagaatcccccccacccccatgaacagcctggtggagagcagccccagcaccgaggagcccgccagcctgtacaccgaggacatgacccagaaggccaccgacaccggccacatgggccccccccagacccacgccagatgcagcagctggtggggcggcctggagatcgacagcaagaacatcgccgacgcctggagcagcagcgagcaggagagcgtgttccagagccccgagagctggaaggagcacaagcccagcagcatcgacagaagagccagcgacagcgtgttccagcccaagagcctggagttcaccaagagcggcccctgggagagcgagttcggccagcccgagctgggcagcaacgacatccaggacaagaacgaggagagcctgcccttccagaacctgcccatggagaagagccccctgcccaacaccagcccccagggcaccaaccacctgatcgaggacttcgccagcctgtggcacagcggcagaagccccaccgccatgcccgagccctggggcaaccccaccgacgacggcgagcccgccgccgtggcccccttccccgcctggagcgccttcggcaaggaggaccacgacgaggccctgaagaacacctggaacctgcaccccaccagcagcaagacccccagcgtgagagaccccaacgagtgggccatggccaagagcggcttcgccttcagcagcagcgagctgctggacaacagccccagcgagatcaacaacgaggccgcccccgagatctggggcaagaagaacaacgacagcagagaccacatcttcgcccccggcaaccccagcagcgacctggaccacacctggaccaacagcaagccccccaaggaggaccagaacggcctggtggaccccaagaccagaggcaaggtgtacgagaaggtggacagctggaacctgttcgaggagaacatgaagaagggcggcagcgacgtgctggtgccctgggaggacagcttcctgagctacaagtgcagcgactacagcgccagcaacctgggcgaggacagcgtgcccagccccctggacaccaactacagcaccagcgacagctacaccagccccaccttcgccggcgacgagaaggagaccgagcacaagcccttcgccaaggaggagggcttcgagagcaaggacggcaacagcaccgccgaggagaccgacatccccccccagagcctgcagcagagcagcagaaacagaatcagcagcggccccggcaacctggacatgtgggccagcccccacaccgacaacagcagcgagatcaacaccacccacaacctggacgagaacgagctgaagaccgagcacaccgacggcaagaacatcagcatggaggacgacgtgggcgagagcagccagagcagctacgacgaccccagcatgatgcagctgtacaacgagaccaacagacagctgaccctgctgcacagcagcaccaacagcagacagaccgcccccgacagcctggacctgtggaacagagtgatcctggaggacacccagagcaccgccaccatcagcgacatggacaacgacctggactgggacgactgcagcggcggcgccgccatccccagcgacggccagaccgagggctacatggccgagggcagcgagcccgagaccagattcaccgtgagacagctggagccctggggcctggagtaccaggaggccaaccaggtggactgggagctgcccgccagcgacgagcacaccaaggacagcgcccccagcgagcaccacaccctgaacgagaagagcggccagctgatcgccaacagcatctgggacagcgtgatgagagacaaggacatgagcagcttcatgctgcccggcagcagccacatcaccgacagcgagcagagagagctgccccccgagatccccagccacagcgccaacgtgaaggacacccacagccccgacgcccccgccgccagcggcaccagcgagagcgaggccctgatcagccacctggacaagcaggacaccgagagagagaccctgcagagcgacgccgccagcctggccaccagactggagaaccccggctacttcccccaccccgacccctggaagggccacggcgacggccagagcgagagcgagaaggaggcccagggcgccaccgacagaggccacctggacgaggaggaggtgatcgccagcggcgtggagaacgccagcggcatcagcgagaagggccagagcgaccaggagctgagcagcctggtggccagcgagcaccaggagatctgcatcaagagcggcaagatcagcagcctggccgtgaccttcagcccccagaccgaggagcccgaggaggtgctggagtacgaggagggcagctacaacctggacagcagagacgtgcagaccggcatgagcgccgacaacctgcagcccaaggacacccacgagaagcacctgatgagccagagaaacagcggcgagaccaccgagaccagcgacggcatgaacttcaccaagtacgtgagcgtgcccgagaaggacctggagaagaccgaggagtgcaacttcctggagcccgagaacgtgggcggcggccccccccacagagtgcccagaagcctggacttcggcgacgtgcccatcgacagcgacgtgcacgtgagcagcacctgcagcgagatcaccaagaacctggacgtgaagggcagcgagaacagcctgcccggcgccggcagcagcggcaacttcgacagagacaccatcagcagcgagtacacccacagcagcgccagcagccccgagctgaacgacagcagcgtggccctgagcagctggggccagcagcccagcagcggctaccaggaggagaaccagggcaactggagcgagcagaaccaccaggagagcgagctgatcaccaccgacggccaggtggagatcgtgaccaaggtgaaggacctggagaagaacagaatcaacgagttcgagaagagcttcgacagaaagacccccaccttcctggagatctggaacgacagcgtggacggcgacagcttcagcagcctgagcagccccgagaccggcaagtacagcgagcacagcggcacccaccaggagagcaacctgatcgccagctaccaggagaagaacgagcacgacatcagcgccaccgtgcagcccgaggacgccagagtgatcagcaccagcagcggcagcgacgacgacagcgtgggcggcgaggagagcatcgaggaggagatccaggtggccaactgccacgtggccgaggacgagagcagagcctgggacagcctgaacgagagcaacaagttcctggtgaccgccgaccccaagagcgagaacatctacgactacctggacagcagcgagcccgccgagaacgagaacaagagcaaccccttctgcgacaaccagcagagcagccccgacccctggaccttcagccccctgaccgagaccgagatgcagatcaccgccgtggagaaggagaagagaagcagccccgagaccggcaccaccggcgacgtggcctggcagatcagccccaaggccagcttccccaagaacgaggacaacagccagctggagatgctgggcttcagcgccgacagcaccgagtggtggaaggccagcccccaggagggcagactgatcgagagccccttcgagagagagctgagcgacagcagcggcgtgctggagatcaacagcagcgtgcaccagaacgccagcccctggggcgtgcccgtgcagggcgacatcgagcccgtggagacccactacaccaaccccttcagcgacaaccaccagagccccttcctggagggcaacggcaagaacagccacgagcagctgtggaacatccagcccagacagcccgaccccgacgccgacaagttcagccagctggtgaagctggaccagatcaaggagaaggacagcagagagcagaccttcgtgagcgccgccggcgacgagctgacccccgagacccccacccaggagcagtgccaggacaccatgctgcccgtgtgcgaccaccccgacaccgccttcacccacgccgaggagaacagctgcgtgaccagcaacgtgagcaccaacgagggccaggagaccaaccagtgggagcaggagaagagctacctgggcgagatgaccaacagcagcatcgccaccgagaacttccccgccgtgagcagccccacccagctgatcatgaagcccggcagcgagtgggacggcagcacccccagcgaggacagcagaggcaccttcgtgcccgacatcctgcacggcaacttccaggagggcggccagctggccagcgccgcccccgacctgtggatcgacgccaagaagcccttcagcctgaaggccgacggcgagaaccccgacatcctgacccactgcgagcacgacagcaacagccaggccagcgacagccccgacatctgccacgacagcgaggccaagcaggagaccgagaagcacctgagcgcctgcatgggccccgaggtggagagcagcgagctgtgcctgaccgagcccgagatcgacgaggagcccatctacgagcccggcagagagttcgtgcccagcaacgccgagctggacagcgagaacgccaccgtgctgccccccatcggctaccaggccgacatcaagggcagcagccagcccgccagccacaagggcagccccgagcccagcgagatcaacggcgacaacagcaccggcctgcaggtgagcgagaagggcgccagccccgacatggcccccatcctggagcccgtggacagaagaatccccagaatcgagaacgtggccaccagcatcttcgtgacccaccaggagcccacccccgagggcgacggcagctggatcagcgacagcttcagccccgagagccagcccggcgccagagccctgttcgacggcgacccccacctgagcaccgagaaccccgccctggtgcccgacgccctgctggccagcgacacctgcctggacatcagcgaggccgccttcgaccacagcttcagcgacgccagcggcctgaacaccagcaccggcaccatcgacgacatgagcaagctgaccctgagcgagggccaccccgagacccccgtggacggcgacctgggcaagcaggacatctgcagcagcgaggccagctggggcgacttcgagtacgacgtgatgggccagaacatcgacgaggacctgctgagagagcccgagcacttcctgtacggcggcgacccccccctggaggaggacagcctgaagcagagcctggccccctacaccccccccttcgacctgagctacctgaccgagcccgcccagagcgccgagaccatcgaggaggccggcagccccgaggacgagagcctgggctgcagagccgccgagatcgtgctgagcgccctgcccgacagaagaagcgagggcaaccaggccgagaccaagaacagactgcccggcagccagctggccgtgctgcacatcagagaggaccccgagagcgtgtacctgcccgtgggcgccggcagcaacatcctgagccccagcaacgtggactgggaggtggagaccgacaacagcgacctgcccgccggcggcgacatcggcccccccaacggcgccagcaaggagatcagcgagctggaggaggagaagaccatccccaccaaggagcccgagcagatcaagagcgagtacaaggaggagagatgcaccgagaagaacgaggacagacacgccctgcacatggactacatcctggtgaacagagaggagaacagccacagcaagcccgagacctgcgaggagagagagagcatcgccgagctggagctgtacgtgggcagcaaggagaccggcctgcagggcacccagctggccagcttccccgacacctgccagcccgccagcctgaacgagagaaagggcctgagcgccgagaagatgagcagcaagagcgacaccagaagcagcttcgagagccccgcccaggaccagagctggatgttcctgggccacagcgaggtgggcgaccccagcctggacgccagagacagcggccccggctggagcggcaagaccgtggagcccttcagcgagctgggcctgggcgagggcccccagctgcagatcctggaggagatgaagcccctggagagcctggccctggaggaggccagcggccccgtgagccagagccagaagagcaagagcagaggcagagccggccccgacgccgtgaccctgcaggccgtgacccacgacaacgagtgggagatgctgagcccccagcccgtgcagaagaacatgatccccgacaccgagatggaggaggagaccgagttcctggagctgggcaccagaatcagcagacccaacggcctgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagctggacgaggagctgagagaggccagcgaggccgccaagaccagctgcctgtacaacgaccccgagatgagcagcatggagaaggacatcgacctgaagctgaaggagaagccctag

SEQ ID NO: 95820 - DNA, 9165 bp, Artificial Sequence
  Description of Artificial Sequence: Synthetic coding sequence
agaaacctgatgcacagaatgaaggagagcgagaacagaagcaagagactggagaaggtgcacgtggtgatcggccccaagagctgcgacctggacagcctgatcagcaccttcacctacgcctacttcctggacaaggtgagcccccccggcgtgctgtgcctgcccgtgctgaacatccccagaaccgagttcaactacttcaccgagaccagattcatcctggaggagctgaacatcagcgagagcttccacatcttcagagacgagatcaacctgcaccagctgaacgacgagggcaagctgagcatcaccctggtgggcagcagcgtgctggccagcgaggacaagaccctggagagcgccgtggtgaaggtgatcaaccccgtggagcagagcgacgccaacgtggagttcagagagagcagcagcagcctggtgctgaaggagatcctgcaggaggcccccgagctgatcaccgagcagctggcccacagactgagaggcagcatcctgttcaagtggatgaccatggagagcgagaagatcagcgagaagcaggaggagatcctgagcatcctggaggagaagttccccaacctgccccccagagaggacatcatcaacgtgctgcaggagacccagttcagcgcccagggcctgagcatcgagcagaccatgctgaaggacctgaaggagctgagcgacggcgagatcaaggtggccatcagcaccgtgagcatgaacctggagaactgcctgttccacagcaacatcaccagcgacctgaaggccttcaccgacaagttcggcttcgacgtgctgatcctgttcagcagctacctgagcgaggagcagcagcccagaagacagatcgccgtgtacagcgagaacatggagctgtgcagccagatctgctgcgagctggaggagtgccagaacccctgcctggagctggagcccttcgactgcggctgcgacgagatcctggtgtaccagcaggaggaccccagcgtgacctgcgaccaggtggtgctggtggtgaaggaggtgatcaacagaagatgccccgagatggtgagcaacagcagaaccagcagcaccgaggccgtggccggcagcgcccccctgagccagggcagcagcggcatcatggagctgtacggcagcgacatcgagccccagcccagcagcgtgaacttcatcgagaacccccccgacctgaacgacagcaaccaggcccaggtggacgccaacgtggacctggtgagccccgacagcggcctggccaccatcagaagcagcagaagcagcaaggagagcagcgtgttcctgagcgacgacagccccgtgggcgagggcgccggcccccaccacaccctgctgcccggcctggacagctacagccccatccccgagggcgccgtggccgaggagcacgcctggagcggcgagcacggcgagcacttcgacctgttcaacttcgaccccgcccccatggccagcggccagagccagcagagcagccacagcgccgactacagccccgccgacgacttcttccccaacagcgacctgagcgagggccagctgcccgccggccccgagggcctggacggcatgggcaccaacatgagcaactacagcagcagcagcctgctgagcggcgccggcaaggacagcctggtggagcacgacgaggagttcgtgcagagacaggacagccccagagacaacagcgagagaaacctgagcctgaccgacttcgtgggcgacgagagccccagccccgagagactgaagaacaccggcaagagaatcccccccacccccatgaacagcctggtggagagcagccccagcaccgaggagcccgccagcctgtacaccgaggacatgacccagaaggccaccgacaccggccacatgggccccccccagacccacgccagatgcagcagctggtggggcggcctggagatcgacagcaagaacatcgccgacgcctggagcagcagcgagcaggagagcgtgttccagagccccgagagctggaaggagcacaagcccagcagcatcgacagaagagccagcgacagcgtgttccagcccaagagcctggagttcaccaagagcggcccctgggagagcgagttcggccagcccgagctgggcagcaacgacatccaggacaagaacgaggagagcctgcccttccagaacctgcccatggagaagagccccctgcccaacaccagcccccagggcaccaaccacctgatcgaggacttcgccagcctgtggcacagcggcagaagccccaccgccatgcccgagccctggggcaaccccaccgacgacggcgagcccgccgccgtggcccccttccccgcctggagcgccttcggcaaggaggaccacgacgaggccctgaagaacacctggaacctgcaccccaccagcagcaagacccccagcgtgagagaccccaacgagtgggccatggccaagagcggcttcgccttcagcagcagcgagctgctggacaacagccccagcgagatcaacaacgaggccgcccccgagatctggggcaagaagaacaacgacagcagagaccacatcttcgcccccggcaaccccagcagcgacctggaccacacctggaccaacagcaagccccccaaggaggaccagaacggcctggtggaccccaagaccagaggcaaggtgtacgagaaggtggacagctggaacctgttcgaggagaacatgaagaagggcggcagcgacgtgctggtgccctgggaggacagcttcctgagctacaagtgcagcgactacagcgccagcaacctgggcgaggacagcgtgcccagccccctggacaccaactacagcaccagcgacagctacaccagccccaccttcgccggcgacgagaaggagaccgagcacaagcccttcgccaaggaggagggcttcgagagcaaggacggcaacagcaccgccgaggagaccgacatccccccccagagcctgcagcagagcagcagaaacagaatcagcagcggccccggcaacctggacatgtgggccagcccccacaccgacaacagcagcgagatcaacaccacccacaacctggacgagaacgagctgaagaccgagcacaccgacggcaagaacatcagcatggaggacgacgtgggcgagagcagccagagcagctacgacgaccccagcatgatgcagctgtacaacgagaccaacagacagctgaccctgctgcacagcagcaccaacagcagacagaccgcccccgacagcctggacctgtggaacagagtgatcctggaggacacccagagcaccgccaccatcagcgacatggacaacgacctggactgggacgactgcagcggcggcgccgccatccccagcgacggccagaccgagggctacatggccgagggcagcgagcccgagaccagattcaccgtgagacagctggagccctggggcctggagtaccaggaggccaaccaggtggactgggagctgcccgccagcgacgagcacaccaaggacagcgcccccagcgagcaccacaccctgaacgagaagagcggccagctgatcgccaacagcatctgggacagcgtgatgagagacaaggacatgagcagcttcatgctgcccggcagcagccacatcaccgacagcgagcagagagagctgccccccgagatccccagccacagcgccaacgtgaaggacacccacagccccgacgcccccgccgccagcggcaccagcgagagcgaggccctgatcagccacctggacaagcaggacaccgagagagagaccctgcagagcgacgccgccagcctggccaccagactggagaaccccggctacttcccccaccccgacccctggaagggccacggcgacggccagagcgagagcgagaaggaggcccagggcgccaccgacagaggccacctggacgaggaggaggtgatcgccagcggcgtggagaacgccagcggcatcagcgagaagggccagagcgaccaggagctgagcagcctggtggccagcgagcaccaggagatctgcatcaagagcggcaagatcagcagcctggccgtgaccttcagcccccagaccgaggagcccgaggaggtgctggagtacgaggagggcagctacaacctggacagcagagacgtgcagaccggcatgagcgccgacaacctgcagcccaaggacacccacgagaagcacctgatgagccagagaaacagcggcgagaccaccgagaccagcgacggcatgaacttcaccaagtacgtgagcgtgcccgagaaggacctggagaagaccgaggagtgcaacttcctggagcccgagaacgtgggcggcggccccccccacagagtgcccagaagcctggacttcggcgacgtgcccatcgacagcgacgtgcacgtgagcagcacctgcagcgagatcaccaagaacctggacgtgaagggcagcgagaacagcctgcccggcgccggcagcagcggcaacttcgacagagacaccatcagcagcgagtacacccacagcagcgccagcagccccgagctgaacgacagcagcgtggccctgagcagctggggccagcagcccagcagcggctaccaggaggagaaccagggcaactggagcgagcagaaccaccaggagagcgagctgatcaccaccgacggccaggtggagatcgtgaccaaggtgaaggacctggagaagaacagaatcaacgagttcgagaagagcttcgacagaaagacccccaccttcctggagatctggaacgacagcgtggacggcgacagcttcagcagcctgagcagccccgagaccggcaagtacagcgagcacagcggcacccaccaggagagcaacctgatcgccagctaccaggagaagaacgagcacgacatcagcgccaccgtgcagcccgaggacgccagagtgatcagcaccagcagcggcagcgacgacgacagcgtgggcggcgaggagagcatcgaggaggagatccaggtggccaactgccacgtggccgaggacgagagcagagcctgggacagcctgaacgagagcaacaagttcctggtgaccgccgaccccaagagcgagaacatctacgactacctggacagcagcgagcccgccgagaacgagaacaagagcaaccccttctgcgacaaccagcagagcagccccgacccctggaccttcagccccctgaccgagaccgagatgcagatcaccgccgtggagaaggagaagagaagcagccccgagaccggcaccaccggcgacgtggcctggcagatcagccccaaggccagcttccccaagaacgaggacaacagccagctggagatgctgggcttcagcgccgacagcaccgagtggtggaaggccagcccccaggagggcagactgatcgagagccccttcgagagagagctgagcgacagcagcggcgtgctggagatcaacagcagcgtgcaccagaacgccagcccctggggcgtgcccgtgcagggcgacatcgagcccgtggagacccactacaccaaccccttcagcgacaaccaccagagccccttcctggagggcaacggcaagaacagccacgagcagctgtggaacatccagcccagacagcccgaccccgacgccgacaagttcagccagctggtgaagctggaccagatcaaggagaaggacagcagagagcagaccttcgtgagcgccgccggcgacgagctgacccccgagacccccacccaggagcagtgccaggacaccatgctgcccgtgtgcgaccaccccgacaccgccttcacccacgccgaggagaacagctgcgtgaccagcaacgtgagcaccaacgagggccaggagaccaaccagtgggagcaggagaagagctacctgggcgagatgaccaacagcagcatcgccaccgagaacttccccgccgtgagcagccccacccagctgatcatgaagcccggcagcgagtgggacggcagcacccccagcgaggacagcagaggcaccttcgtgcccgacatcctgcacggcaacttccaggagggcggccagctggccagcgccgcccccgacctgtggatcgacgccaagaagcccttcagcctgaaggccgacggcgagaaccccgacatcctgacccactgcgagcacgacagcaacagccaggccagcgacagccccgacatctgccacgacagcgaggccaagcaggagaccgagaagcacctgagcgcctgcatgggccccgaggtggagagcagcgagctgtgcctgaccgagcccgagatcgacgaggagcccatctacgagcccggcagagagttcgtgcccagcaacgccgagctggacagcgagaacgccaccgtgctgccccccatcggctaccaggccgacatcaagggcagcagccagcccgccagccacaagggcagccccgagcccagcgagatcaacggcgacaacagcaccggcctgcaggtgagcgagaagggcgccagccccgacatggcccccatcctggagcccgtggacagaagaatccccagaatcgagaacgtggccaccagcatcttcgtgacccaccaggagcccacccccgagggcgacggcagctggatcagcgacagcttcagccccgagagccagcccggcgccagagccctgttcgacggcgacccccacctgagcaccgagaaccccgccctggtgcccgacgccctgctggccagcgacacctgcctggacatcagcgaggccgccttcgaccacagcttcagcgacgccagcggcctgaacaccagcaccggcaccatcgacgacatgagcaagctgaccctgagcgagggccaccccgagacccccgtggacggcgacctgggcaagcaggacatctgcagcagcgaggccagctggggcgacttcgagtacgacgtgatgggccagaacatcgacgaggacctgctgagagagcccgagcacttcctgtacggcggcgacccccccctggaggaggacagcctgaagcagagcctggccccctacaccccccccttcgacctgagctacctgaccgagcccgcccagagcgccgagaccatcgaggaggccggcagccccgaggacgagagcctgggctgcagagccgccgagatcgtgctgagcgccctgcccgacagaagaagcgagggcaaccaggccgagaccaagaacagactgcccggcagccagctggccgtgctgcacatcagagaggaccccgagagcgtgtacctgcccgtgggcgccggcagcaacatcctgagccccagcaacgtggactgggaggtggagaccgacaacagcgacctgcccgccggcggcgacatcggcccccccaacggcgccagcaaggagatcagcgagctggaggaggagaagaccatccccaccaaggagcccgagcagatcaagagcgagtacaaggaggagagatgcaccgagaagaacgaggacagacacgccctgcacatggactacatcctggtgaacagagaggagaacagccacagcaagcccgagacctgcgaggagagagagagcatcgccgagctggagctgtacgtgggcagcaaggagaccggcctgcagggcacccagctggccagcttccccgacacctgccagcccgccagcctgaacgagagaaagggcctgagcgccgagaagatgagcagcaagagcgacaccagaagcagcttcgagagccccgcccaggaccagagctggatgttcctgggccacagcgaggtgggcgaccccagcctggacgccagagacagcggccccggctggagcggcaagaccgtggagcccttcagcgagctgggcctgggcgagggcccccagctgcagatcctggaggagatgaagcccctggagagcctggccctggaggaggccagcggccccgtgagccagagccagaagagcaagagcagaggcagagccggccccgacgccgtgaccctgcaggccgtgacccacgacaacgagtgggagatgctgagcccccagcccgtgcagaagaacatgatccccgacaccgagatggaggaggagaccgagttcctggagctgggcaccagaatcagcagacccaacggcctgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaggaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggcagcagaggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaactactag

SEQ ID NO: 95821 - DNA, 783 bp, Artificial Sequence
  Description of Artificial Sequence: Synthetic coding sequence
atcgacatcaacgtggacgagctggacacccccgacgaggccgacagcttcgagtacaccggccacgaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggcgacagcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagtacgacgaggagagaagctacaagagaagcgtgagaaccagctgcctgtacaacgaccccgagatgagcagcatggagaaggacatcgacctgaagctgaaggagaagccctag

SEQ ID NO: 95822 - DNA, 7155 bp, Artificial Sequence
  Description of Artificial Sequence: Synthetic coding sequence
tgattccagagccccgagagctggaaggagcacaagcccagcagcatcgacagaagagccagcgacagcgtgttccagcccaagagcctggagttcaccaagagcggcccctgggagagcgagttcggccagcccgagctgggcagcaacgacatccaggacaagaacgaggagagcctgcccttccagaacctgcccatggagaagagccccctgcccaacaccagcccccagggcaccaaccacctgatcgaggacttcgccagcctgtggcacagcggcagaagccccaccgccatgcccgagccctggggcaaccccaccgacgacggcgagcccgccgccgtggcccccttccccgcctggagcgccttcggcaaggaggaccacgacgaggccctgaagaacacctggaacctgcaccccaccagcagcaagacccccagcgtgagagaccccaacgagtgggccatggccaagagcggcttcgccttcagcagcagcgagctgctggacaacagccccagcgagatcaacaacgaggccgcccccgagatctggggcaagaagaacaacgacagcagagaccacatcttcgcccccggcaaccccagcagcgacctggaccacacctggaccaacagcaagccccccaaggaggaccagaacggcctggtggaccccaagaccagaggcaaggtgtacgagaaggtggacagctggaacctgttcgaggagaacatgaagaagggcggcagcgacgtgctggtgccctgggaggacagcttcctgagctacaagtgcagcgactacagcgccagcaacctgggcgaggacagcgtgcccagccccctggacaccaactacagcaccagcgacagctacaccagccccaccttcgccggcgacgagaaggagaccgagcacaagcccttcgccaaggaggagggcttcgagagcaaggacggcaacagcaccgccgaggagaccgacatccccccccagagcctgcagcagagcagcagaaacagaatcagcagcggccccggcaacctggacatgtgggccagcccccacaccgacaacagcagcgagatcaacaccacccacaacctggacgagaacgagctgaagaccgagcacaccgacggcaagaacatcagcatggaggacgacgtgggcgagagcagccagagcagctacgacgaccccagcatgatgcagctgtacaacgagaccaacagacagctgaccctgctgcacagcagcaccaacagcagacagaccgcccccgacagcctggacctgtggaacagagtgatcctggaggacacccagagcaccgccaccatcagcgacatggacaacgacctggactgggacgactgcagcggcggcgccgccatccccagcgacggccagaccgagggctacatggccgagggcagcgagcccgagaccagattcaccgtgagacagctggagccctggggcctggagtaccaggaggccaaccaggtggactgggagctgcccgccagcgacgagcacaccaaggacagcgcccccagcgagcaccacaccctgaacgagaagagcggccagctgatcgccaacagcatctgggacagcgtgatgagagacaaggacatgagcagcttcatgctgcccggcagcagccacatcaccgacagcgagcagagagagctgccccccgagatccccagccacagcgccaacgtgaaggacacccacagccccgacgcccccgccgccagcggcaccagcgagagcgaggccctgatcagccacctggacaagcaggacaccgagagagagaccctgcagagcgacgccgccagcctggccaccagactggagaaccccggctacttcccccaccccgacccctggaagggccacggcgacggccagagcgagagcgagaaggaggcccagggcgccaccgacagaggccacctggacgaggaggaggtgatcgccagcggcgtggagaacgccagcggcatcagcgagaagggccagagcgaccaggagctgagcagcctggtggccagcgagcaccaggagatctgcatcaagagcggcaagatcagcagcctggccgtgaccttcagcccccagaccgaggagcccgaggaggtgctggagtacgaggagggcagctacaacctggacagcagagacgtgcagaccggcatgagcgccgacaacctgcagcccaaggacacccacgagaagcacctgatgagccagagaaacagcggcgagaccaccgagaccagcgacggcatgaacttcaccaagtacgtgagcgtgcccgagaaggacctggagaagaccgaggagtgcaacttcctggagcccgagaacgtgggcggcggccccccccacagagtgcccagaagcctggacttcggcgacgtgcccatcgacagcgacgtgcacgtgagcagcacctgcagcgagatcaccaagaacctggacgtgaagggcagcgagaacagcctgcccggcgccggcagcagcggcaacttcgacagagacaccatcagcagcgagtacacccacagcagcgccagcagccccgagctgaacgacagcagcgtggccctgagcagctggggccagcagcccagcagcggctaccaggaggagaaccagggcaactggagcgagcagaaccaccaggagagcgagctgatcaccaccgacggccaggtggagatcgtgaccaaggtgaaggacctggagaagaacagaatcaacgagttcgagaagagcttcgacagaaagacccccaccttcctggagatctggaacgacagcgtggacggcgacagcttcagcagcctgagcagccccgagaccggcaagtacagcgagcacagcggcacccaccaggagagcaacctgatcgccagctaccaggagaagaacgagcacgacatcagcgccaccgtgcagcccgaggacgccagagtgatcagcaccagcagcggcagcgacgacgacagcgtgggcggcgaggagagcatcgaggaggagatccaggtggccaactgccacgtggccgaggacgagagcagagcctgggacagcctgaacgagagcaacaagttcctggtgaccgccgaccccaagagcgagaacatctacgactacctggacagcagcgagcccgccgagaacgagaacaagagcaaccccttctgcgacaaccagcagagcagccccgacccctggaccttcagccccctgaccgagaccgagatgcagatcaccgccgtggagaaggagaagagaagcagccccgagaccggcaccaccggcgacgtggcctggcagatcagccccaaggccagcttccccaagaacgaggacaacagccagctggagatgctgggcttcagcgccgacagcaccgagtggtggaaggccagcccccaggagggcagactgatcgagagccccttcgagagagagctgagcgacagcagcggcgtgctggagatcaacagcagcgtgcaccagaacgccagcccctggggcgtgcccgtgcagggcgacatcgagcccgtggagacccactacaccaaccccttcagcgacaaccaccagagccccttcctggagggcaacggcaagaacagccacgagcagctgtggaacatccagcccagacagcccgaccccgacgccgacaagttcagccagctggtgaagctggaccagatcaaggagaaggacagcagagagcagaccttcgtgagcgccgccggcgacgagctgacccccgagacccccacccaggagcagtgccaggacaccatgctgcccgtgtgcgaccaccccgacaccgccttcacccacgccgaggagaacagctgcgtgaccagcaacgtgagcaccaacgagggccaggagaccaaccagtgggagcaggagaagagctacctgggcgagatgaccaacagcagcatcgccaccgagaacttccccgccgtgagcagccccacccagctgatcatgaagcccggcagcgagtgggacggcagcacccccagcgaggacagcagaggcaccttcgtgcccgacatcctgcacggcaacttccaggagggcggccagctggccagcgccgcccccgacctgtggatcgacgccaagaagcccttcagcctgaaggccgacggcgagaaccccgacatcctgacccactgcgagcacgacagcaacagccaggccagcgacagccccgacatctgccacgacagcgaggccaagcaggagaccgagaagcacctgagcgcctgcatgggccccgaggtggagagcagcgagctgtgcctgaccgagcccgagatcgacgaggagcccatctacgagcccggcagagagttcgtgcccagcaacgccgagctggacagcgagaacgccaccgtgctgccccccatcggctaccaggccgacatcaagggcagcagccagcccgccagccacaagggcagccccgagcccagcgagatcaacggcgacaacagcaccggcctgcaggtgagcgagaagggcgccagccccgacatggcccccatcctggagcccgtggacagaagaatccccagaatcgagaacgtggccaccagcatcttcgtgacccaccaggagcccacccccgagggcgacggcagctggatcagcgacagcttcagccccgagagccagcccggcgccagagccctgttcgacggcgacccccacctgagcaccgagaaccccgccctggtgcccgacgccctgctggccagcgacacctgcctggacatcagcgaggccgccttcgaccacagcttcagcgacgccagcggcctgaacaccagcaccggcaccatcgacgacatgagcaagctgaccctgagcgagggccaccccgagacccccgtggacggcgacctgggcaagcaggacatctgcagcagcgaggccagctggggcgacttcgagtacgacgtgatgggccagaacatcgacgaggacctgctgagagagcccgagcacttcctgtacggcggcgacccccccctggaggaggacagcctgaagcagagcctggccccctacaccccccccttcgacctgagctacctgaccgagcccgcccagagcgccgagaccatcgaggaggccggcagccccgaggacgagagcctgggctgcagagccgccgagatcgtgctgagcgccctgcccgacagaagaagcgagggcaaccaggccgagaccaagaacagactgcccggcagccagctggccgtgctgcacatcagagaggaccccgagagcgtgtacctgcccgtgggcgccggcagcaacatcctgagccccagcaacgtggactgggaggtggagaccgacaacagcgacctgcccgccggcggcgacatcggcccccccaacggcgccagcaaggagatcagcgagctggaggaggagaagaccatccccaccaaggagcccgagcagatcaagagcgagtacaaggaggagagatgcaccgagaagaacgaggacagacacgccctgcacatggactacatcctggtgaacagagaggagaacagccacagcaagcccgagacctgcgaggagagagagagcatcgccgagctggagctgtacgtgggcagcaaggagaccggcctgcagggcacccagctggccagcttccccgacacctgccagcccgccagcctgaacgagagaaagggcctgagcgccgagaagatgagcagcaagagcgacaccagaagcagcttcgagagccccgcccaggaccagagctggatgttcctgggccacagcgaggtgggcgaccccagcctggacgccagagacagcggccccggctggagcggcaagaccgtggagcccttcagcgagctgggcctgggcgagggcccccagctgcagatcctggaggagatgaagcccctggagagcctggccctggaggaggccagcggccccgtgagccagagccagaagagcaagagcagaggcagagccggccccgacgccgtgaccctgcaggccgtgacccacgacaacgagtgggagatgctgagcccccagcccgtgcagaagaacatgatccccgacaccgagatggaggaggagaccgagttcctggagctgggcaccagaatcagcagacccaacggcctgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggcgacagcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaacatcgacctgaagctgaaggagaagccctag

SEQ ID NO: 95823 - DNA, 8193 bp, Artificial Sequence
  Description of Artificial Sequence: Synthetic coding sequence
atggtgagcaacagcagaaccagcagcaccgaggccgtggccggcagcgcccccctgagccagggcagcagcggcatcatggagctgtacggcagcgacatcgagccccagcccagcagcgtgaacttcatcgagaacccccccgacctgaacgacagcaaccaggcccaggtggacgccaacgtggacctggtgagccccgacagcggcctggccaccatcagaagcagcagaagcagcaaggagagcagcgtgttcctgagcgacgacagccccgtgggcgagggcgccggcccccaccacaccctgctgcccggcctggacagctacagccccatccccgagggcgccgtggccgaggagcacgcctggagcggcgagcacggcgagcacttcgacctgttcaacttcgaccccgcccccatggccagcggccagagccagcagagcagccacagcgccgactacagccccgccgacgacttcttccccaacagcgacctgagcgagggccagctgcccgccggccccgagggcctggacggcatgggcaccaacatgagcaactacagcagcagcagcctgctgagcggcgccggcaaggacagcctggtggagcacgacgaggagttcgtgcagagacaggacagccccagagacaacagcgagagaaacctgagcctgaccgacttcgtgggcgacgagagccccagccccgagagactgaagaacaccggcaagagaatcccccccacccccatgaacagcctggtggagagcagccccagcaccgaggagcccgccagcctgtacaccgaggacatgacccagaaggccaccgacaccggccacatgggccccccccagacccacgccagatgcagcagctggtggggcggcctggagatcgacagcaagaacatcgccgacgcctggagcagcagcgagcaggagagcgtgttccagagccccgagagctggaaggagcacaagcccagcagcatcgacagaagagccagcgacagcgtgttccagcccaagagcctggagttcaccaagagcggcccctgggagagcgagttcggccagcccgagctgggcagcaacgacatccaggacaagaacgaggagagcctgcccttccagaacctgcccatggagaagagccccctgcccaacaccagcccccagggcaccaaccacctgatcgaggacttcgccagcctgtggcacagcggcagaagccccaccgccatgcccgagccctggggcaaccccaccgacgacggcgagcccgccgccgtggcccccttccccgcctggagcgccttcggcaaggaggaccacgacgaggccctgaagaacacctggaacctgcaccccaccagcagcaagacccccagcgtgagagaccccaacgagtgggccatggccaagagcggcttcgccttcagcagcagcgagctgctggacaacagccccagcgagatcaacaacgaggccgcccccgagatctggggcaagaagaacaacgacagcagagaccacatcttcgcccccggcaaccccagcagcgacctggaccacacctggaccaacagcaagccccccaaggaggaccagaacggcctggtggaccccaagaccagaggcaaggtgtacgagaaggtggacagctggaacctgttcgaggagaacatgaagaagggcggcagcgacgtgctggtgccctgggaggacagcttcctgagctacaagtgcagcgactacagcgccagcaacctgggcgaggacagcgtgcccagccccctggacaccaactacagcaccagcgacagctacaccagccccaccttcgccggcgacgagaaggagaccgagcacaagcccttcgccaaggaggagggcttcgagagcaaggacggcaacagcaccgccgaggagaccgacatccccccccagagcctgcagcagagcagcagaaacagaatcagcagcggccccggcaacctggacatgtgggccagcccccacaccgacaacagcagcgagatcaacaccacccacaacctggacgagaacgagctgaagaccgagcacaccgacggcaagaacatcagcatggaggacgacgtgggcgagagcagccagagcagctacgacgaccccagcatgatgcagctgtacaacgagaccaacagacagctgaccctgctgcacagcagcaccaacagcagacagaccgcccccgacagcctggacctgtggaacagagtgatcctggaggacacccagagcaccgccaccatcagcgacatggacaacgacctggactgggacgactgcagcggcggcgccgccatccccagcgacggccagaccgagggctacatggccgagggcagcgagcccgagaccagattcaccgtgagacagctggagccctggggcctggagtaccaggaggccaaccaggtggactgggagctgcccgccagcgacgagcacaccaaggacagcgcccccagcgagcaccacaccctgaacgagaagagcggccagctgatcgccaacagcatctgggacagcgtgatgagagacaaggacatgagcagcttcatgctgcccggcagcagccacatcaccgacagcgagcagagagagctgccccccgagatccccagccacagcgccaacgtgaaggacacccacagccccgacgcccccgccgccagcggcaccagcgagagcgaggccctgatcagccacctggacaagcaggacaccgagagagagaccctgcagagcgacgccgccagcctggccaccagactggagaaccccggctacttcccccaccccgacccctggaagggccacggcgacggccagagcgagagcgagaaggaggcccagggcgccaccgacagaggccacctggacgaggaggaggtgatcgccagcggcgtggagaacgccagcggcatcagcgagaagggccagagcgaccaggagctgagcagcctggtggccagcgagcaccaggagatctgcatcaagagcggcaagatcagcagcctggccgtgaccttcagcccccagaccgaggagcccgaggaggtgctggagtacgaggagggcagctacaacctggacagcagagacgtgcagaccggcatgagcgccgacaacctgcagcccaaggacacccacgagaagcacctgatgagccagagaaacagcggcgagaccaccgagaccagcgacggcatgaacttcaccaagtacgtgagcgtgcccgagaaggacctggagaagaccgaggagtgcaacttcctggagcccgagaacgtgggcggcggccccccccacagagtgcccagaagcctggacttcggcgacgtgcccatcgacagcgacgtgcacgtgagcagcacctgcagcgagatcaccaagaacctggacgtgaagggcagcgagaacagcctgcccggcgccggcagcagcggcaacttcgacagagacaccatcagcagcgagtacacccacagcagcgccagcagccccgagctgaacgacagcagcgtggccctgagcagctggggccagcagcccagcagcggctaccaggaggagaaccagggcaactggagcgagcagaaccaccaggagagcgagctgatcaccaccgacggccaggtggagatcgtgaccaaggtgaaggacctggagaagaacagaatcaacgagttcgagaagagcttcgacagaaagacccccaccttcctggagatctggaacgacagcgtggacggcgacagcttcagcagcctgagcagccccgagaccggcaagtacagcgagcacagcggcacccaccaggagagcaacctgatcgccagctaccaggagaagaacgagcacgacatcagcgccaccgtgcagcccgaggacgccagagtgatcagcaccagcagcggcagcgacgacgacagcgtgggcggcgaggagagcatcgaggaggagatccaggtggccaactgccacgtggccgaggacgagagcagagcctgggacagcctgaacgagagcaacaagttcctggtgaccgccgaccccaagagcgagaacatctacgactacctggacagcagcgagcccgccgagaacgagaacaagagcaaccccttctgcgacaaccagcagagcagccccgacccctggaccttcagccccctgaccgagaccgagatgcagatcaccgccgtggagaaggagaagagaagcagccccgagaccggcaccaccggcgacgtggcctggcagatcagccccaaggccagcttccccaagaacgaggacaacagccagctggagatgctgggcttcagcgccgacagcaccgagtggtggaaggccagcccccaggagggcagactgatcgagagccccttcgagagagagctgagcgacagcagcggcgtgctggagatcaacagcagcgtgcaccagaacgccagcccctggggcgtgcccgtgcagggcgacatcgagcccgtggagacccactacaccaaccccttcagcgacaaccaccagagccccttcctggagggcaacggcaagaacagccacgagcagctgtggaacatccagcccagacagcccgaccccgacgccgacaagttcagccagctggtgaagctggaccagatcaaggagaaggacagcagagagcagaccttcgtgagcgccgccggcgacgagctgacccccgagacccccacccaggagcagtgccaggacaccatgctgcccgtgtgcgaccaccccgacaccgccttcacccacgccgaggagaacagctgcgtgaccagcaacgtgagcaccaacgagggccaggagaccaaccagtgggagcaggagaagagctacctgggcgagatgaccaacagcagcatcgccaccgagaacttccccgccgtgagcagccccacccagctgatcatgaagcccggcagcgagtgggacggcagcacccccagcgaggacagcagaggcaccttcgtgcccgacatcctgcacggcaacttccaggagggcggccagctggccagcgccgcccccgacctgtggatcgacgccaagaagcccttcagcctgaaggccgacggcgagaaccccgacatcctgacccactgcgagcacgacagcaacagccaggccagcgacagccccgacatctgccacgacagcgaggccaagcaggagaccgagaagcacctgagcgcctgcatgggccccgaggtggagagcagcgagctgtgcctgaccgagcccgagatcgacgaggagcccatctacgagcccggcagagagttcgtgcccagcaacgccgagctggacagcgagaacgccaccgtgctgccccccatcggctaccaggccgacatcaagggcagcagccagcccgccagccacaagggcagccccgagcccagcgagatcaacggcgacaacagcaccggcctgcaggtgagcgagaagggcgccagccccgacatggcccccatcctggagcccgtggacagaagaatccccagaatcgagaacgtggccaccagcatcttcgtgacccaccaggagcccacccccgagggcgacggcagctggatcagcgacagcttcagccccgagagccagcccggcgccagagccctgttcgacggcgacccccacctgagcaccgagaaccccgccctggtgcccgacgccctgctggccagcgacacctgcctggacatcagcgaggccgccttcgaccacagcttcagcgacgccagcggcctgaacaccagcaccggcaccatcgacgacatgagcaagctgaccctgagcgagggccaccccgagacccccgtggacggcgacctgggcaagcaggacatctgcagcagcgaggccagctggggcgacttcgagtacgacgtgatgggccagaacatcgacgaggacctgctgagagagcccgagcacttcctgtacggcggcgacccccccctggaggaggacagcctgaagcagagcctggccccctacaccccccccttcgacctgagctacctgaccgagcccgcccagagcgccgagaccatcgaggaggccggcagccccgaggacgagagcctgggctgcagagccgccgagatcgtgctgagcgccctgcccgacagaagaagcgagggcaaccaggccgagaccaagaacagactgcccggcagccagctggccgtgctgcacatcagagaggaccccgagagcgtgtacctgcccgtgggcgccggcagcaacatcctgagccccagcaacgtggactgggaggtggagaccgacaacagcgacctgcccgccggcggcgacatcggcccccccaacggcgccagcaaggagatcagcgagctggaggaggagaagaccatccccaccaaggagcccgagcagatcaagagcgagtacaaggaggagagatgcaccgagaagaacgaggacagacacgccctgcacatggactacatcctggtgaacagagaggagaacagccacagcaagcccgagacctgcgaggagagagagagcatcgccgagctggagctgtacgtgggcagcaaggagaccggcctgcagggcacccagctggccagcttccccgacacctgccagcccgccagcctgaacgagagaaagggcctgagcgccgagaagatgagcagcaagagcgacaccagaagcagcttcgagagccccgcccaggaccagagctggatgttcctgggccacagcgaggtgggcgaccccagcctggacgccagagacagcggccccggctggagcggcaagaccgtggagcccttcagcgagctgggcctgggcgagggcccccagctgcagatcctggaggagatgaagcccctggagagcctggccctggaggaggccagcggccccgtgagccagagccagaagagcaagagcagaggcagagccggccccgacgccgtgaccctgcaggccgtgacccacgacaacgagtgggagatgctgagcccccagcccgtgcagaagaacatgatccccgacaccgagatggaggaggagaccgagttcctggagctgggcaccagaatcagcagacccaacggcctgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaggaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagctggacgaggagctgagagaggccagcgaggccgccaagaccagctgcctgtacaacgaccccgagatgagcagcatggagaaggacatcgacctgaagctgaaggagaagccctag

SEQ ID NO: 95824 - DNA, 927 bp, Artificial Sequence
  Description of Artificial Sequence: Synthetic coding sequence
atgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggcaagctgagatactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagtacgacgaggagagaagctacaagagaagcgtgagaaccagctgcctgtacaacgaccccgagatgagcagcatggagaaggacatcgacctgaagctgaaggagaagccctag

SEQ ID NO: 95825 - DNA, 1014 bp, Artificial Sequence
  Description of Artificial Sequence: Synthetic coding sequence
atgaacggcctgagaaacaagcagctgctgagcgaggacgtgggcatggacatccccttcgaggagggcgtgctgagccccagcgccgccgacatgagacccgagccccccaacagcctggacctgaacgacacccaccccagaagaatcaagctgaccgcccccaacatcaacctgagcctggaccagagcgagggcagcatcctgagcgacgacaacctggacagccccgacgagatcgacatcaacgtggacgagctggacacccccgacgaggccgacagcttcgagtacaccggccacgaccccaccgccaacaaggacagcggccaggagagcgagagcatccccgagtacaccgccgaggaggagagagaggacaacagactgtggagaaccgtggtgatcggcgagcaggagcagagaatcgacatgaaggtgatcgagccctacagaagagtgatcagccacggcggctactacggcgacggcctgaacgccatcatcgtgttcgccgcctgcttcctgcccgacagcagcagagccgactaccactacgtgatggagaacctgttcctgtacgtgatcagcaccctggagctgatggtggccgaggactacatgatcgtgtacctgaacggcgccacccccagaagaagaatgcccggcctgggctggatgaagaagtgctaccagatgatcgacagaagactgagaaagaacctgaagagcttcatcatcgtgcaccccagctggttcatcagaaccatcctggccgtgaccagacccttcatcagcagcaagttcagcagcaagatcaagtacgtgaacagcctgagcgagctgagcggcctgatccccatggactgcatccacatccccgagagcatcatcaagctggacgaggagctgagagaggccagcgaggccgccaagaccagctgcctgtacaacgaccccgagatgagcagcatggagaaggacatcgacctgaagctgaaggagaagccctag

SEQ ID NO: 95826 - DNA, 1155 bp, Artificial Sequence
  Description of Artificial Sequence: Synthetic coding sequence
atggccggcaacgccgagcccccccccgccggcgccgcctgcccccaggacagaagaagctgcagcggcagagccggcggcgacagagtgtgggaggacggcgagcaccccgccaagaagctgaagagcggcggcgacgaggagagaagagagaagccccccaagagaaagatcgtgctgctgatggcctacagcggcaagggctaccacggcatgcagagaaacgtgggcagcagccagttcaagaccatcgaggacgacctggtgagcgccctggtgagaagcggctgcatccccgagaaccacggcgaggacatgagaaagatgagcttccagagatgcgccagaaccgacaagggcgtgagcgccgccggccaggtggtgagcctgaaggtgtggctgatcgacgacatcctggagaagatcaacagccacctgcccagccacatcagaatcctgggcctgaagagagtgaccggcggcttcaacagcaagaacagatgcgacgccagaacctactgctacctgctgcccaccttcgccttcgcccacaaggacagagacgtgcaggacgagacctacagactgagcgccgagaccctgcagcaggtgaacagactgctggcctgctacaagggcacccacaacttccacaacttcaccagccagaagggcccccaggaccccagcgcctgcagatacatcctggagatgtactgcgaggagcccttcgtgagagagggcctggagttcgccgtgatcagagtgaagggccagagcttcatgatgcaccagatcagaaagatggtgggcctggtggtggccatcgtgaagggctacgcccccgagagcgtgctggagagaagctggggcaccgagaaggtggacgtgcccaaggcccccggcctgggcctggtgctggagagagtgcacttcgagaagtacaaccagagattcggcaacgacggcctgcacgagcccctggactgggcccaggaggagggcaaggtggccgccttcaaggaggagcacatctaccccaccatcatcggcaccgagagagacgagagaagcatggcccagtggctgagcaccctgcccatccacaacttcagcgccaccgccctgaccgccggcggcaccggcgccaagtag

SEQ ID NO: 95827 - DNA, 1284 bp, Artificial Sequence
  Description of Artificial Sequence: Synthetic coding sequence
atgggcctgcagctgagagccctgctgggcgccttcggcagatggaccctgagactgggccccagacccagctgcagccccagaatggccggcaacgccgagcccccccccgccggcgccgcctgcccccaggacagaagaagctgcagcggcagagccggcggcgacagagtgtgggaggacggcgagcaccccgccaagaagctgaagagcggcggcgacgaggagagaagagagaagccccccaagagaaagatcgtgctgctgatggcctacagcggcaagggctaccacggcatgcagagaaacgtgggcagcagccagttcaagaccatcgaggacgacctggtgagcgccctggtgagaagcggctgcatccccgagaaccacggcgaggacatgagaaagatgagcttccagagatgcgccagaaccgacaagggcgtgagcgccgccggccaggtggtgagcctgaaggtgtggctgatcgacgacatcctggagaagatcaacagccacctgcccagccacatcagaatcctgggcctgaagagagtgaccggcggcttcaacagcaagaacagatgcgacgccagaacctactgctacctgctgcccaccttcgccttcgcccacaaggacagagacgtgcaggacgagacctacagactgagcgccgagaccctgcagcaggtgaacagactgctggcctgctacaagggcacccacaacttccacaacttcaccagccagaagggcccccaggaccccagcgcctgcagatacatcctggagatgtactgcgaggagcccttcgtgagagagggcctggagttcgccgtgatcagagtgaagggccagagcttcatgatgcaccagatcagaaagatggtgggcctggtggtggccatcgtgaagggctacgcccccgagagcgtgctggagagaagctggggcaccgagaaggtggacgtgcccaaggcccccggcctgggcctggtgctggagagagtgcacttcgagaagtacaaccagagattcggcaacgacggcctgcacgagcccctggactgggcccaggaggagggcaaggtggccgccttcaaggaggagcacatctaccccaccatcatcggcaccgagagagacgagagaagcatggcccagtggctgagcaccctgcccatccacaacttcagcgccaccgccctgaccgccggcggcaccggcgccaaggtgcccagccccctggagggcagcgagggcgacggcgacaccgactag

SEQ ID NO: 95828 - DNA, 1200 bp, Artificial Sequence
  Description of Artificial Sequence: Synthetic coding sequence
atggccggcaacgccgagcccccccccgccggcgccgcctgcccccaggacagaagaagctgcagcggcagagccggcggcgacagagtgtgggaggacggcgagcaccccgccaagaagctgaagagcggcggcgacgaggagagaagagagaagccccccaagagaaagatcgtgctgctgatggcctacagcggcaagggctaccacggcatgcagagaaacgtgggcagcagccagttcaagaccatcgaggacgacctggtgagcgccctggtgagaagcggctgcatccccgagaaccacggcgaggacatgagaaagatgagcttccagagatgcgccagaaccgacaagggcgtgagcgccgccggccaggtggtgagcctgaaggtgtggctgatcgacgacatcctggagaagatcaacagccacctgcccagccacatcagaatcctgggcctgaagagagtgaccggcggcttcaacagcaagaacagatgcgacgccagaacctactgctacctgctgcccaccttcgccttcgcccacaaggacagagacgtgcaggacgagacctacagactgagcgccgagaccctgcagcaggtgaacagactgctggcctgctacaagggcacccacaacttccacaacttcaccagccagaagggcccccaggaccccagcgcctgcagatacatcctggagatgtactgcgaggagcccttcgtgagagagggcctggagttcgccgtgatcagagtgaagggccagagcttcatgatgcaccagatcagaaagatggtgggcctggtggtggccatcgtgaagggctacgcccccgagagcgtgctggagagaagctggggcaccgagaaggtggacgtgcccaaggcccccggcctgggcctggtgctggagagagtgcacttcgagaagtacaaccagagattcggcaacgacggcctgcacgagcccctggactgggcccaggaggagggcaaggtggccgccttcaaggaggagcacatctaccccaccatcatcggcaccgagagagacgagagaagcatggcccagtggctgagcaccctgcccatccacaacttcagcgccaccgccctgaccgccggcggcaccggcgccaaggtgcccagccccctggagggcagcgagggcgacggcgacaccgactag

SEQ ID NO: 95829 - DNA, 1200 bp, Artificial Sequence; identical to SEQ ID NO: 95828
  Description of Artificial Sequence: Synthetic coding sequence

SEQ ID NO: 95830 - DNA, 465 bp, Artificial Sequence
  Description of Artificial Sequence: Synthetic coding sequence
atggccggcaacgccgagcccccccccgccggcgccgcctgcccccaggacagaagaagctgcagcggcagagccggcggcgacagagtgtgggaggacggcgagcaccccgccaagaagctgaagagcggcggcgacgaggagagaagagagaagccccccaagagaaagatcgtgctgctgatggcctacagcggcaagggctaccacggcatgcagagaaacgtgggcagcagccagttcaagaccatcgaggacgacctggtgagcgccctggtgagaagcggctgcatccccgagaaccacggcgaggacatgagaaagatgagcttccagagatgcgccagaaccgacaagggcgtgagcgccgccggccaggtggtgagcctgaaggtgtggctgatcgacgacatcctggagaagatcaacagccacctgcccagccacatcagaatcctgggctag

SEQ ID NO: 95831 - DNA, 618 bp, Artificial Sequence
  Description of Artificial Sequence: Synthetic coding sequence
atgagcaagggcagagccgaggccgccgccggcgccgccggcatcctgctgagatacctgcaggagcagaacagaccctacagcagccaggacgtgttcggcaacctgcagagagagcacggcctgggcaaggccgtggtggtgaagaccctggagcagctggcccagcagggcaagatcaaggagaagatgtacggcaagcagaagatctacttcgccgaccaggaccagttcgacatggtgagcgacgccgacctgcaggtgctggacggcaagatcgtggccctgaccgccaaggtgcagagcctgcagcagagctgcagatacatggaggccgagatgcagaaggagatccaggagctgaagaaggagtgcgccggctacagagagagactgaagaacatcaaggccgccaccaaccacgtgacccccgaggagaaggagcaggtgtacagagagagacagaagtactgcaaggagtggagaaagagaaagagaatggccaccgagctgagcgacgccatcctggagggctaccccaagagcaagaagcagttcttcgaggaggtgggcatcgagaccgacgaggactacaacgtgaccctgcccgacccctag

SEQ ID NO: 95832 - DNA, 654 bp, Artificial Sequence
  Description of Artificial Sequence: Synthetic coding sequence
atgagcaagggcagagccgaggccgccgccggcgccgccggcatcctgctgagatacctgcaggagcagaacagaccctacagcagccaggacgtgttcggcaacctgcagagagagcacggcctgggcaaggccgtggtggtgaagaccctggagcagctggcccagcagggcaagatcaaggagaagatgtacggcaagcagaagatctacttcgccgaccaggaccagttcgacatggtgagcgacgccgacctgcaggtgctggacggcaagatcgtggccctgaccgccaaggtgcagagcctgcagcagagctgcagatacatggaggccgagctgaaggagctgagcagcgccctgaccacccccgagatgcagaaggagatccaggagctgaagaaggagtgcgccggctacagagagagactgaagaacatcaaggccgccaccaaccacgtgacccccgaggagaaggagcaggtgtacagagagagacagaagtactgcaaggagtggagaaagagaaagagaatggccaccgagctgagcgacgccatcctggagggctaccccaagagcaagaagcagttcttcgaggaggtgggcatcgagaccgacgaggactacaacgtgaccctgcccgacccctag

SEQ ID NO: 95833 - DNA, 465 bp, Artificial Sequence
  Description of Artificial Sequence: Synthetic coding sequence
atgtacggcaagcagaagatctacttcgccgaccaggaccagttcgacatggtgagcgacgccgacctgcaggtgctggacggcaagatcgtggccctgaccgccaaggtgcagagcctgcagcagagctgcagatacatggaggccgagctgaaggagctgagcagcgccctgaccacccccgagatgcagaaggagatccaggagctgaagaaggagtgcgccggctacagagagagactgaagaacatcaaggccgccaccaaccacgtgacccccgaggagaaggagcaggtgtacagagagagacagaagtactgcaaggagtggagaaagagaaagagaatggccaccgagctgagcgacgccatcctggagggctaccccaagagcaagaagcagttcttcgaggaggtgggcatcgagaccgacgaggactacaacgtgaccctgcccgacccctag

SEQ ID NO: 95834 - DNA, 915 bp, Artificial Sequence
  Description of Artificial Sequence: Synthetic coding sequence
atgttcagcgtgctgagctacggcagactggtggccagagccgtgctgggcggcctgagccagaccgaccccagagccggcggcggcggcggcggcgactacggcctggtgaccgccggctgcggcttcggcaaggacttcagaaagggcctgctgaagaagggcgcctgctacggcgacgacgcctgcttcgtggccagacacagaagcgccgacgtgctgggcgtggccgacggcgtgggcggctggagagactacggcgtggaccccagccagttcagcggcaccctgatgagaacctgcgagagactggtgaaggagggcagattcgtgcccagcaaccccatcggcatcctgaccaccagctactgcgagctgctgcagaacaaggtgcccctgctgggcagcagcaccgcctgcatcgtggtgctggacagaaccagccacagactgcacaccgccaacctgggcgacagcggcttcctggtggtgagaggcggcgaggtggtgcacagaagcgacgagcagcagcactacttcaacacccccttccagctgagcatcgccccccccgaggccgagggcgtggtgctgagcgacagccccgacgccgccgacagcaccagcttcgacgtgcagctgggcgacatcatcctgaccgccaccgacggcctgttcgacaacatgcccgactacatgatcctgcaggagctgaagaagctgaagaacagcaactacgagagcatccagcagaccgccagaagcatcgccgagcaggcccacgagctggcctacgaccccaactacatgagccccttcgcccagttcgcctgcgacaacggcctgaacgtgagaggcggcaagcccgacgacatcaccgtgctgctgagcatcgtggccgagtacaccgactag

SEQ ID NO: 95835 - DNA, 1746 bp, Artificial Sequence
  Description of Artificial Sequence: Synthetic coding sequence
atggccgtgagacaggccctgggcagaggcctgcagctgggcagagccctgctgctgagattcaccggcaagcccggcagagcctacggcctgggcagacccggccccgccgccggctgcgtgagaggcgagagacccggctgggccgccggccccggcgccgagcccagaagagtgggcctgggcctgcccaacagactgagattcttcagacagagcgtggccggcctggccgccagactgcagagacagttcgtggtgagagcctggggctgcgccggcccctgcggcagagccgtgttcctggccttcggcctgggcctgggcctgatcgaggagaagcaggccgagagcagaagagccgtgagcgcctgccaggagatccaggccatcttcacccagaagagcaagcccggccccgaccccctggacaccagaagactgcagggcttcagactggaggagtacctgatcggccagagcatcggcaagggctgcagcgccgccgtgtacgaggccaccatgcccaccctgccccagaacctggaggtgaccaagagcaccggcctgctgcccggcagaggccccggcaccagcgcccccggcgagggccaggagagagcccccggcgcccccgccttccccctggccatcaagatgatgtggaacatcagcgccggcagcagcagcgaggccatcctgaacaccatgagccaggagctggtgcccgccagcagagtggccctggccggcgagtacggcgccgtgacctacagaaagagcaagagaggccccaagcagctggccccccaccccaacatcatcagagtgctgagagccttcaccagcagcgtgcccctgctgcccggcgccctggtggactaccccgacgtgctgcccagcagactgcaccccgagggcctgggccacggcagaaccctgttcctggtgatgaagaactacccctgcaccctgagacagtacctgtgcgtgaacacccccagccccagactggccgccatgatgctgctgcagctgctggagggcgtggaccacctggtgcagcagggcatcgcccacagagacctgaagagcgacaacatcctggtggagctggaccccgacggctgcccctggctggtgatcgccgacttcggctgctgcctggccgacgagagcatcggcctgcagctgcccttcagcagctggtacgtggacagaggcggcaacggctgcctgatggcccccgaggtgagcaccgccagacccggccccagagccgtgatcgactacagcaaggccgacgcctgggccgtgggcgccatcgcctacgagatcttcggcctggtgaaccccttctacggccagggcaaggcccacctggagagcagaagctaccaggaggcccagctgcccgccctgcccgagagcgtgccccccgacgtgagacagctggtgagagccctgctgcagagagaggccagcaagagacccagcgccagagtggccgccaacgtgctgcacctgagcctgtggggcgagcacatcctggccctgaagaacctgaagctggacaagatggtgggctggctgctgcagcagagcgccgccaccctgctggccaacagactgaccgagaagtgctgcgtggagaccaagatgaagatgctgttcctggccaacctggagtgcgagaccctgtgccaggccgccctgctgctgtgcagctggagagccgccctgtag

SEQ ID NO: 95836 - DNA, 393 bp, Artificial Sequence
  Description of Artificial Sequence: Synthetic coding sequence
atggccgccgtgctgggcgccctgggcgccaccagaagactgctggccgccctgagaggccagagcctgggcctggccgccatgagcagcggcacccacagactgaccgccgaggagagaaaccaggccatcctggacctgaaggccgccggctggagcgagctgagcgagagagacgccatctacaaggagttcagcttccacaacttcaaccaggccttcggcttcatgagcagagtggccctgcaggccgagaagatgaaccaccaccccgagtggttcaacgtgtacaacaaggtgcagatcaccctgaccagccacgactgcggcgagctgaccaagaaggacgtgaagctggccaagttcatcgagaaggccgccgccagcgtgtag

SEQ ID NO: 95837 - DNA, 393 bp, Artificial Sequence; identical to SEQ ID NO: 95836
  Description of Artificial Sequence: Synthetic coding sequence

SEQ ID NO: 95838 - DNA, 1041 bp, Artificial Sequence
  Description of Artificial Sequence: Synthetic coding sequence
atggccctgctgaaggtgaagttcgaccagaagaagagagtgaagctggcccagggcctgtggctgatgaactggttcagcgtgctggccggcatcatcatcttcagcctgggcctgttcctgaagatcgagctgagaaagagaagcgacgtgatgaacaacagcgagagccacttcgtgcccaacagcctgatcggcatgggcgtgctgagctgcgtgttcaacagcctggccggcaagatctgctacgacgccctggaccccgccaagtacgccagatggaagccctggctgaagccctacctggccatctgcgtgctgttcaacatcatcctgttcctggtggccctgtgctgcttcctgctgagaggcagcctggagaacaccctgggccagggcctgaagaacggcatgaagtactacagagacaccgacacccccggcagatgcttcatgaagaagaccatcgacatgctgcagatcgagttcaagtgctgcggcaacaacggcttcagagactggttcgagatccagtggatcagcaacagatacctggacttcagcagcaaggaggtgaaggacagaatcaagagcaacgtggacggcagatacctggtggacggcgtgcccttcagctgctgcaaccccagcagccccagaccctgcatccagtaccagatcaccaacaacagcgcccactacagctacgaccaccagaccgaggagctgaacctgtgggtgagaggctgcagagccgccctgctgagctactacagcagcctgatgaacagcatgggcgtggtgaccctgctgatctggctgttcgaggtgaccatcaccatcggcctgagatacctgcagaccagcctggacggcgtgagcaaccccgaggagagcgagagcgagagccagggctggctgctggagagaagcgtgcccgagacctggaaggccttcctggagagcgtgaagaagctgggcaagggcaaccaggtggaggccgagggcgccgacgccggccaggcccccgaggccggctag

SEQ ID NO: 95839 - DNA, 1191 bp, Artificial Sequence
  Description of Artificial Sequence: Synthetic coding sequence
atgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccaccgtgcccagctggctgaagaagccccaggacagccagctggaggagggcaagcccggctacctggactgcctgacccaggccacccccaagcccaccgtggtgtggtacagaaaccagatgctgatcagcgaggacagcagattcgaggtgttcctggccaaggcccagggcctggaggagggcgtggccgagaccctggtgctggtgaagagcctgcagagcaaggacgagcagcagcagctggacttcagaagagagctggagatgttcggcaagctgaaccacgccaacgtggtgagactgctgggcctgtgcagagaggccgagccccactacatggtgctggagtacgtggacctgggcgacctgaagcagttcctgagaatcagcaagagcaaggacgagaagctgaagagccagcccctgagcaccaagcagaaggtggccctgtgcacccaggtggccctgggcatggagcacctgagcaacaacagattcgtgcacaaggacctggccgccagaaactgcctggtgagcgcccagagacaggtgaaggtgagcgccctgggcctgagcaaggacgtgtacaacagcgagtactaccacttcagacaggcctgggtgcccctgagatggatgagccccgaggccatcctggagggcgacttcagcaccaagagcgacgtgtgggccttcggcgtgctgatgtgggaggtgttcacccacggcgagatgccccacggcggccaggccgacgacgaggtgctggccgacctgcaggccggcaaggccagactgccccagcccgagggctgccccagcaagctgtacagactgatgcagagatgctgggccctgagccccaaggacagacccagcttcagcgagatcgccagcgccctgggcgacagcaccgtggacagcaagccctag

SEQ ID NO: 95840 - DNA, 3093 bp, Artificial Sequence
  Description of Artificial Sequence: Synthetic coding sequence
atgggcgccgccagaggcagccccgccagacccagaagactgcccctgctgagcgtgctgctgctgcccctgctgggcggcacccagaccgccatcgtgttcatcaagcagcccagcagccaggacgccctgcagggcagaagagccctgctgagatgcgaggtggaggcccccggccccgtgcacgtgtactggctgctggacggcgcccccgtgcaggacaccgagagaagattcgcccagggcagcagcctgagcttcgccgccgtggacagactgcaggacagcggcaccttccagtgcgtggccagagacgacgtgaccggcgaggaggccagaagcgccaacgccagcttcaacatcaagtggatcgaggccggccccgtggtgctgaagcaccccgccagcgaggccgagatccagccccagacccaggtgaccctgagatgccacatcgacggccaccccagacccacctaccagtggttcagagacggcacccccctgagcgacggccagagcaaccacaccgtgagcagcaaggagagaaacctgaccctgagacccgccggccccgagcacagcggcctgtacagctgctgcgcccacagcgccttcggccaggcctgcagcagccagaacttcaccctgagcatcgccgacgagagcttcgccagagtggtgctggccccccaggacgtggtggtggccagatacgaggaggccatgttccactgccagttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccaccgtgcccagctggctgaagaagccccaggacagccagctggaggagggcaagcccggctacctggactgcctgacccaggccacccccaagcccaccgtggtgtggtacagaaaccagatgctgatcagcgaggacagcagattcgaggtgttcaagaacggcaccctgagaatcaacagcgtggaggtgtacgacggcacctggtacagatgcatgagcagcacccccgccggcagcatcgaggcccaggccagagtgcaggtgctggacggcagcagcctgcccgagtgggtgaccgacaacgccggcaccctgcacttcgccagagtgaccagagacgacgccggcaactacacctgcatcgccagcaacggcccccagggccagatcagagcccacgtgcagctgaccgtggccgtgttcatcaccttcaaggtggagcccgagagaaccaccgtgtaccagggccacaccgccctgctgcagtgcgaggcccagggcgaccccaagcccctgatccagtggaagggcaaggacagaatcctggaccccaccaagctgggccccagaatgcacatcttccagaacggcagcctggtgatccacgacgtggcccccgaggacagcggcagatacacctgcatcgccggcaacagctgcaacatcaagcacaccgaggcccccctgtacgtggtggacaagcccgtgcccgaggagagcgagggccccggcagcccccccccctacaagatgatccagaccatcggcctgagcgtgggcgccgccgtggcctacatcatcgccgtgctgggcctgatgttctactgcaagaagagatgcaaggccaagagactgcagaagcagcccgagggcgaggagcccgagatggagtgcctgaacggcggccccctgcagaacggccagcccagcgccgagatccaggaggaggtggccctgaccagcctgggcagcggccccgccgccaccaacaagagacacagcaccagcgacaagatgcacttccccagaagcagcctgcagcccatcaccaccctgggcaagagcgagttcggcgaggtgttcctggccaaggcccagggcctggaggagggcgtggccgagaccctggtgctggtgaagagcctgcagagcaaggacgagcagcagcagctggacttcagaagagagctggagatgttcggcaagctgaaccacgccaacgtggtgagactgctgggcctgtgcagagaggccgagccccactacatggtgctggagtacgtggacctgggcgacctgaagcagttcctgagaatcagcaagagcaaggacgagaagctgaagagccagcccctgagcaccaagcagaaggtggccctgtgcacccaggtggccctgggcatggagcacctgagcaacaacagattcgtgcacaaggacctggccgccagaaactgcctggtgagcgcccagagacaggtgaaggtgagcgccctgggcctgagcaaggacgtgtacaacagcgagtactaccacttcagacaggcctgggtgcccctgagatggatgagccccgaggccatcctggagggcgacttcagcaccaagagcgacgtgtgggccttcggcgtgctgatgtgggaggtgttcacccacggcgagatgccccacggcggccaggccgacgacgaggtgctggccgacctgcaggccggcaaggccagactgccccagcccgagggctgccccagcaagctgtacagactgatgcagagatgctgggccctgagccccaaggacagacccagcttcagcgagatcgccagcgccctgggcgacagcaccgtggacagcaagccctag

SEQ ID NO: 95841 - DNA, 2823 bp, Artificial Sequence
  Description of Artificial Sequence: Synthetic coding sequence
atgggcgccgccagaggcagccccgccagacccagaagactgcccctgctgagcgtgctgctgctgcccctgctgggcggcacccagaccgccatcgtgttcatcaagcagcccagcagccaggacgccctgcagggcagaagagccctgctgagatgcgaggtggaggcccccggccccgtgcacgtgtactggctgctggacggcgcccccgtgcaggacaccgagagaagattcgcccagggcagcagcctgagcttcgccgccgtggacagactgcaggacagcggcaccttccagtgcgtggccagagacgacgtgaccggcgaggaggccagaagcgccaacgccagcttcaacatcaagtggatcgaggccggccccgtggtgctgaagcaccccgccagcgaggccgagatccagccccagacccaggtgaccctgagatgccacatcgacggccaccccagacccacctaccagtggttcagagacggcacccccctgagcgacggccagagcaaccacaccgtgagcagcaaggagagaaacctgaccctgagacccgccggccccgagcacagcggcctgtacagctgctgcgcccacagcgccttcggccaggcctgcagcagccagaacttcaccctgagcatcgccgacgagagcttcgccagagtggtgctggccccccaggacgtggtggtggccagatacgaggaggccatgttccactgccagttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccaacggcagcagcctgcccgagtgggtgaccgacaacgccggcaccctgcacttcgccagagtgaccagagacgacgccggcaactacacctgcatcgccagcaacggcccccagggccagatcagagcccacgtgcagctgaccgtggccgtgttcatcaccttcaaggtggagcccgagagaaccaccgtgtaccagggccacaccgccctgctgcagtgcgaggcccagggcgaccccaagcccctgatccagtggaagggcaaggacagaatcctggaccccaccaagctgggccccagaatgcacatcttccagaacggcagcctggtgatccacgacgtggcccccgaggacagcggcagatacacctgcatcgccggcaacagctgcaacatcaagcacaccgaggcccccctgtacgtggtggacaagcccgtgcccgaggagagcgagggccccggcagcccccccccctacaagatgatccagaccatcggcctgagcgtgggcgccgccgtggcctacatcatcgccgtgctgggcctgatgttctactgcaagaagagatgcaaggccaagagactgcagaagcagcccgagggcgaggagcccgagatggagtgcctgaacggcggccccctgcagaacggccagcccagcgccgagatccaggaggaggtggccctgaccagcctgggcagcggccccgccgccaccaacaagagacacagcaccagcgacaagatgcacttccccagaagcagcctgcagcccatcaccaccctgggcaagagcgagttcggcgaggtgttcctggccaaggcccagggcctggaggagggcgtggccgagaccctggtgctggtgaagagcctgcagagcaaggacgagcagcagcagctggacttcagaagagagctggagatgttcggcaagctgaaccacgccaacgtggtgagactgctgggcctgtgcagagaggccgagccccactacatggtgctggagtacgtggacctgggcgacctgaagcagttcctgagaatcagcaagagcaaggacgagaagctgaagagccagcccctgagcaccaagcagaaggtggccctgtgcacccaggtggccctgggcatggagcacctgagcaacaacagattcgtgcacaaggacctggccgccagaaactgcctggtgagcgcccagagacaggtgaaggtgagcgccctgggcctgagcaaggacgtgtacaacagcgagtactaccacttcagacaggcctgggtgcccctgagatggatgagccccgaggccatcctggagggcgacttcagcaccaagagcgacgtgtgggccttcggcgtgctgatgtgggaggtgttcacccacggcgagatgccccacggcggccaggccgacgacgaggtgctggccgacctgcaggccggcaaggccagactgccccagcccgagggctgccccagcaagctgtacagactgatgcagagatgctgggccctgagccccaaggacagacccagcttcagcgagatcgccagcgccctgggcgacagcaccgtggacagcaagccctag

SEQ ID NO: 95842 - DNA, 3045 bp, Artificial Sequence
  Description of Artificial Sequence: Synthetic coding sequence
atgggcgccgccagaggcagccccgccagacccagaagactgcccctgctgagcgtgctgctgctgcccctgctgggcggcacccagaccgccatcgtgttcatcaagcagcccagcagccaggacgccctgcagggcagaagagccctgctgagatgcgaggtggaggcccccggccccgtgcacgtgtactggctgctggacggcgcccccgtgcaggacaccgagagaagattcgcccagggcagcagcctgagcttcgccgccgtggacagactgcaggacagcggcaccttccagtgcgtggccagagacgacgtgaccggcgaggaggccagaagcgccaacgccagcttcaacatcaagtggatcgaggccggccccgtggtgctgaagcaccccgccagcgaggccgagatccagccccagacccaggtgaccctgagatgccacatcgacggccaccccagacccacctaccagtggttcagagacggcacccccctgagcgacggccagagcaaccacaccgtgagcagcaaggagagaaacctgaccctgagacccgccggccccgagcacagcggcctgtacagctgctgcgcccacagcgccttcggccaggcctgcagcagccagaacttcaccctgagcatcgccgacgagagcttcgccagagtggtgctggccccccaggacgtggtggtggccagatacgaggaggccatgttccactgccagttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccaccgtgcccagctggctgaagaagccccaggacagccagctggaggagggcaagcccggctacctggactgcctgacccaggccacccccaagcccaccgtggtgtggtacagaaaccagatgctgatcagcgaggacagcagattcgaggtgttcaagaacggcaccctgagaatcaacagcgtggaggtgtacgacggcacctggtacagatgcatgagcagcacccccgccggcagcatcgaggcccaggccagagtgcaggtgctggagaagctgaagttcaccccccccccccagccccagcagtgcatggagttcgacaaggaggccaccgtgccctgcagcgccaccggcagagagaagcccaccatcaagtgggagagagccgacggcagcagcctgcccgagtgggtgaccgacaacgccggcaccctgcacttcgccagagtgaccagagacgacgccggcaactacacctgcatcgccagcaacggcccccagggccagatcagagcccacgtgcagctgaccgtggccgtgttcatcaccttcaaggtggagcccgagagaaccaccgtgtaccagggccacaccgccctgctgcagtgcgaggcccagggcgaccccaagcccctgatccagtggaaggacaagcccgtgcccgaggagagcgagggccccggcagcccccccccctacaagatgatccagaccatcggcctgagcgtgggcgccgccgtggcctacatcatcgccgtgctgggcctgatgttctactgcaagaagagatgcaaggccaagagactgcagaagcagcccgagggcgaggagcccgagatggagtgcctgaacggcggccccctgcagaacggccagcccagcgccgagatccaggaggaggtggccctgaccagcctgggcagcggccccgccgccaccaacaagagacacagcaccagcgacaagatgcacttccccagaagcagcctgcagcccatcaccaccctgggcaagagcgagttcggcgaggtgttcctggccaaggcccagggcctggaggagggcgtggccgagaccctggtgctggtgaagagcctgcagagcaaggacgagcagcagcagctggacttcagaagagagctggagatgttcggcaagctgaaccacgccaacgtggtgagactgctgggcctgtgcagagaggccgagccccactacatggtgctggagtacgtggacctgggcgacctgaagcagttcctgagaatcagcaagagcaaggacgagaagctgaagagccagcccctgagcaccaagcagaaggtggccctgtgcacccaggtggccctgggcatggagcacctgagcaacaacagattcgtgcacaaggacctggccgccagaaactgcctggtgagcgcccagagacaggtgaaggtgagcgccctgggcctgagcaaggacgtgtacaacagcgagtactaccacttcagacaggcctgggtgcccctgagatggatgagccccgaggccatcctggagggcgacttcagcaccaagagcgacgtgtgggccttcggcgtgctgatgtgggaggtgttcacccacggcgagatgccccacggcggccaggccgacgacgaggtgctggccgacctgcaggccggcaaggccagactgccccagcccgagggctgccccagcaagctgtacagactgatgcagagatgctgggccctgagccccaaggacagacccagcttcagcgagatcgccagcgccctgggcgacagcaccgtggacagcaagccctag

SEQ ID NO: 95843 - DNA, 1212 bp, Artificial Sequence
  Description of Artificial Sequence: Synthetic coding sequence
atgggcagcttcctgagcggcgagaagagacccagcgcccccaccgtgggcagcgccatggagaagaaggagttccccaccccccccggcagagtgggccccggcacccagaccgccatcgtgttcatcaagcagcccagcagccaggacgccctgcagggcagaagagccctgctgagatgcgaggtggaggcccccggccccgtgcacgtgtactggctgctggacggcgcccccgtgcaggacaccgagagaagattcgcccagggcagcagcctgagcttcgccgccgtggacagactgcaggacagcggcaccttccagtgcgtggccagagacgacgtgaccggcgaggaggccagaagcgccaacgccagcttcaacatcaagtggatcgaggccggccccgtggtgctgaagcaccccgccagcgaggccgagatccagccccagacccaggtgaccctgagatgccacatcgacggccaccccagacccacctaccagtggttcagagacggcacccccctgagcgacggccagagcaaccacaccgtgagcagcaaggagagaaacctgaccctgagacccgccggccccgagcacagcggcctgtacagctgctgcgcccacagcgccttcggccaggcctgcagcagccagaacttcaccctgagcatcgccgacgagagcttcgccagagtggtgctggccccccaggacgtggtggtggccagatacgaggaggccatgttccactgccagttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccatggccggcagcaccagaagagccaccagctggtgctggcccatcctgctgaaggtgatgctggtgagcacccccgccaccagacccacctggctggtgagcggcgacagaatgagcaccagcctgtggcccctgtgcccccccggctag

SEQ ID NO: 95844 - DNA, 810 bp, Artificial Sequence
  Description of Artificial Sequence: Synthetic coding sequence
ttcagcgcccagcccccccccagcctgcagtggctgttcgaggacgagacccccatcaccaacagaagcagacccccccacctgagaagagccaccgtgttcgccaacggcagcctgctgctgacccaggtgagacccagaaacgccggcatctacagatgcatcggccagggccagagaggcccccccatcatcctggaggccaccctgcacctggccgagatcgaggacatgcccctgttcgagcccagagtgttcaccgccggcagcgaggagagagtgacctgcctgccccccaagggcctgcccgagcccagcgtgtggtgggagcacgccggcgtgagactgcccacccacggcagagtgtaccagaagggccacgagctggtgctggccaacatcgccgagagcgacgccggcgtgtacacctgccacgccgccaacctggccggccagagaagacaggacgtgaacatcaccgtggccagcgagcacctgtgccccgagggccagggcgaggtggagggcaacaccggcctgggcgtgatggacagaggcttccccgccgtgcccagctggctgaagaagccccaggacagccagctggaggagggcaagcccggctacctggactgcctgacccaggccacccccaagcccaccgtggtgtggtacagaaaccagatgctgatcagcgaggacagcagattcgaggtgttcaagaacggcaccctgagaatcaacagcgtggaggtgtacgacggcacctggtacagatgcatgagcagcacccccgccggcagcatctag

SEQ ID NO: 95845 - DNA, 444 bp, Artificial Sequence
  Description of Artificial Sequence: Synthetic coding sequence
atgggcgccaccggcctgggcttcctgctgagctggagacaggacaacctgaacggcaccgactgccagggctgcaacatcctgtacttcagcgagaccaccggcagcatgtgcagcgagctgagcctgaacagaggcctggaggccagaagaaagaaggacctgaaggacagcttcctgtggagatacggcaaggtgggctgcatcagcctgcccctgagagagatgaccgcctggatcaaccccccccagatcagcgagatcttccagggctaccaccagagagtgcacggcgccgacgccctgagcctgcagaccaacagcctgagaagcagactgagcagccagtgcctgggccagagcttcctgctgagaaccctggagagaggcagaggcttcagagccctgggcgacatctgcggccacgtgcacgaggaggactag

SEQ ID NO: 95846 - DNA, 216 bp, Artificial Sequence
  Description of Artificial Sequence: Synthetic coding sequence
atgggcgccaccggcctgggcttcctgctgagctggagacaggacaacctgaacggcaccgactgccagggctgcaacatcctgtacttcagcgagaccaccggcagcatgtgcagcgagctgagcctgaacagaggcctggaggccagaagaaagaaggacctgaaggacagcttcctgtggagagacggcgtgagcccctgcctgccctgctag

SEQ ID NO: 95847 - DNA, 444 bp, Artificial Sequence; identical to SEQ ID NO: 95845
  Description of Artificial Sequence: Synthetic coding sequence

SEQ ID NO: 95848 - DNA, 216 bp, Artificial Sequence; identical to SEQ ID NO: 95846
  Description of Artificial Sequence: Synthetic coding sequence

SEQ ID NO: 95849 - DNA, 3561 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccggcgacaacatccacgccgagcaccaggtgagaagcatggacgagctgaaccacgacttccaggccctggccctggagggcagagccatgggcgagcagctgctgcccggcaagaagttctgggagaccgacgagagcagcaaggacggccccaagggcatcttcctgggcgaccagtggagagacagcgcctggggcaccagcgaccacagcgtgagccagcccatcatggtgcagagaagacccggccagagcttccacgtgaacagcgaggtgaacagcgtgctgagccccagaagcgagagcggcggcctgggcgtgagcatggtggagtacgtgctgagcagcagccccggcgacagctgcctgagaaagggcggcttcggccccagagacgccgacagcgacgagaacgacaagggcgagaagaagaacaagggcaccttcgacggcgacaagctgggcgacctgaaggaggagggcgacgtgatggacaagaccaacggcctgcccgtgcagaacggcatcgacgccgacgtgaaggacttcagcagaacccccggcaactgccagaacagcgccaacgaggtggacctgctgggccccaaccagaacggcagcgagggcctggcccagctgaccagcaccaacggcgccaagcccgtggaggacttcagcaacatggagagccagagcgtgcccctggaccccatggagcacgtgggcatggagcccctgcagttcgactacagcggcacccaggtgcccgtggacagcgccgccgccaccgtgggcctgttcgactacaacagccagcagcagctgttccagagacccaacgccctggccgtgcagcagctgaccgccgcccagcagcagcagtacgccctggccgccgcccaccagccccacatcggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcaggtgctgagaggcggcgccagccagagacccctgacccccaaccagaaccagcagggccagcagaccgaccccctggtggccgccgccgccgtgaacagcgccctggccttcggccagggcctggccgccggcatgcccggctaccccgtgctggcccccgccgcctactacgaccagaccggcgccctggtggtgaacgccggcgccagaaacggcctgggcgcccccgtgagactggtggcccccgcccccgtgatcatcagcagcagcgccgcccaggccgccgtggccgccgccgccgccagcgccaacggcgccgccggcggcctggccggcaccaccaacggccccttcagacccctgggcacccagcagccccagccccagccccagcagcagcccaacaacaacctggccagcagcagcttctacggcaacaacagcctgaacagcaacagccagagcagcagcctgttcagccagggcagcgcccagcccgccaacaccagcctgggcttcggcagcagcagcagcctgggcgccaccctgggcagcgccctgggcggcttcggcaccgccgtggccaacagcaacaccggcagcggcagcagaagagacagcctgaccggcagcagcgacctgtacaagagaaccagcagcagcctgacccccatcggccacagcttctacaacggcctgagcttcagcagcagccccggccccgtgggcatgcccctgcccagccagggccccggccacagccagacccccccccccagcctgagcagccacggcagcagcagcagcctgaacctgggcggcctgaccaacggcagcggcagatacatcagcgccgcccccggcgccgaggccaagtacagaagcgccagcagcgccagcagcctgttcagccccagcagcaccctgttcagcagcagcagactgagatacggcatgagcgacgtgatgcccagcggcagaagcagactgctggaggacttcagaaacaacagataccccaacctgcagctgagagagatcgccggccacatcatggagttcagccaggaccagcacggcagcagattcatccagctgaagctggagagagccacccccgccgagagacagctggtgttcaacgagatcctgcaggccgcctaccagctgatggtggacgtgttcggcaactacgtgatccagaagttcttcgagttcggcagcctggagcagaagctggccctggccgagagaatcagaggccacgtgctgagcctggccctgcagatgtacggctgcagagtgatccagaaggccctggagttcatccccagcgaccagcagaacgagatggtgagagagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgccctgagcacccacccctacggctgcagagtgatccagagaatcctggagcactgcctgcccgaccagaccctgcccatcctggaggagctgcaccagcacaccgagcagctggtgcaggaccagtacggcaactacgtgatccagcacgtgctggagcacggcagacccgaggacaagagcaagatcgtggccgagatcagaggcaacgtgctggtgctgagccagcacaagttcgccagcaacgtggtggagaagtgcgtgacccacgccagcagaaccgagagagccgtgctgatcgacgaggtgtgcaccatgaacgacggcccccacagcgccctgtacaccatgatgaaggaccagtacgccaactacgtggtgcagaagatgatcgacgtggccgagcccggccagagaaagatcgtgatgcacaagatcagaccccacatcgccaccctgagaaagtacacctacggcaagcacatcctggccaagctggagaagtactacatgaagaacggcgtggacctgggccccatctgcggcccccccaacggcatcatctag

SEQ ID NO: 95850 - DNA, 2781 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccaccgtgggcctgttcgactacaacagccagcagcagctgttccagagacccaacgccctggccgtgcagcagctgaccgccgcccagcagcagcagtacgccctggccgccgcccaccagccccacatcggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcaggtgctgagaggcggcgccagccagagacccctgacccccaaccagaaccagcagggccagcagaccgaccccctggtggccgccgccgccgtgaacagcgccctggccttcggccagggcctggccgccggcatgcccggctaccccgtgctggcccccgccgcctactacgaccagaccggcgccctggtggtgaacgccggcgccagaaacggcctgggcgcccccgtgagactggtggcccccgcccccgtgatcatcagcagcagcgccgcccaggccgccgtggccgccgccgccgccagcgccaacggcgccgccggcggcctggccggcaccaccaacggccccttcagacccctgggcacccagcagccccagccccagccccagcagcagcccaacaacaacctggccagcagcagcttctacggcaacaacagcctgaacagcaacagccagagcagcagcctgttcagccagggcagcgcccagcccgccaacaccagcctgggcttcggcagcagcagcagcctgggcgccaccctgggcagcgccctgggcggcttcggcaccgccgtggccaacagcaacaccggcagcggcagcagaagagacagcctgaccggcagcagcgacctgtacaagagaaccagcagcagcctgacccccatcggccacagcttctacaacggcctgagcttcagcagcagccccggccccgtgggcatgcccctgcccagccagggccccggccacagccagacccccccccccagcctgagcagccacggcagcagcagcagcctgaacctgggcggcctgaccaacggcagcggcagatacatcagcgccgcccccggcgccgaggccaagtacagaagcgccagcagcgccagcagcctgttcagccccagcagcaccctgttcagcagcagcagactgagatacggcatgagcgacgtgatgcccagcggcagaagcagactgctggaggacttcagaaacaacagataccccaacctgcagctgagagagatcgccggccacatcatggagttcagccaggaccagcacggcagcagattcatccagctgaagctggagagagccacccccgccgagagacagctggtgttcaacgagatcctgcaggccgcctaccagctgatggtggacgtgttcggcaactacgtgatccagaagttcttcgagttcggcagcctggagcagaagctggccctggccgagagaatcagaggccacgtgctgagcctggccctgcagatgtacggctgcagagtgatccagaaggccctggagttcatccccagcgaccagcaggtgatcaacgagatggtgagagagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgccctgagcacccacccctacggctgcagagtgatccagagaatcctggagcactgcctgcccgaccagaccctgcccatcctggaggagctgcaccagcacaccgagcagctggtgcaggaccagtacggcaactacgtgatccagcacgtgctggagcacggcagacccgaggacaagagcaagatcgtggccgagatcagaggcaacgtgctggtgctgagccagcacaagttcgccagcaacgtggtggagaagtgcgtgacccacgccagcagaaccgagagagccgtgctgatcgacgaggtgtgcaccatgaacgacggcccccacagcgccctgtacaccatgatgaaggaccagtacgccaactacgtggtgcagaagatgatcgacgtggccgagcccggccagagaaagatcgtgatgcacaagatcagaccccacatcgccaccctgagaaagtacacctacggcaagcacatcctggccaagctggagaagtactacatgaagaacggcgtggacctgggccccatctgcggcccccccaacggcatcatctag

SEQ ID NO: 95851 - DNA, 3135 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccggcgacaacatccacgccgagcaccaggtgagaagcatggacgagctgaaccacgacttccaggccctggccctggagggcagagccatgggcgagggccccagagacgccgacagcgacgagaacgacaagggcgagaagaagaacaagggcaccttcgacggcgacaagctgggcgacctgaaggaggagggcgacgtgatggacaagaccaacggcctgcccgtgcagaacggcatcgacgccgacgtgaaggacttcagcagaacccccggcaactgccagaacagcgccaacgaggtggacctgctgggccccaaccagaacggcagcgagggcctggcccagctgaccagcaccaacggcgccaagcccgtggaggacttcagcaacatggagagccagagcgtgcccctggaccccatggagcacgtgggcatggagcccctgcagttcgactacagcggcacccaggtgcccgtggacagcgccgccgccaccgtgggcctgttcgactacaacagccagcagcagctgttccagagacccaacgccctggccgtgcagcagctgaccgccgcccagcagcagcagtacgccctggccgccgcccaccagccccacatcggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcaggtgctgagaggcggcgccagccagagacccctgacccccaaccagaaccagcagggccagcagaccgaccccctggtggccgccgccgccgtgaacagcgccctggccttcggccagggcctggccgccggcatgcccgccgtggccgccgccgccgccagcgccaacggcgccgccggcggcctggccggcaccaccaacggccccttcagacccctgggcacccagcagccccagccccagccccagcagcagcccaacaacaacctggccagcagcagcttctacggcaacaacagcctgaacagcaacagccagagcagcagcctgttcagccagggcagcgcccagcccgccaacaccagcctgggcttcggcagcagcagcagcctgggcgccaccctgggcagcgccctgggcggcttcggcaccgccgtggccaacagcaacaccggcagcggcagcagaagagacagcctgaccggcagcagcgacctgtacaagagaaccagcagcagcctgacccccatcggccacagcttctacaacggcctgagcttcagcagcagccccggccccgtgggcatgcccctgcccagccagggccccggccacagccagacccccccccccagcctgagcagccacggcagcagcagcagcctgaacctgggcggcctgaccaacggcagcggcagatacatcagcgccgcccccggcgccgaggccaagtacagaagcgccagcagcgccagcagcctgttcagccccagcagcaccctgttcagcagcagcagactgagatacggcatgagcgacgtgatgcccagcggcagaagcagactgctggaggacttcagaaacaacagataccccaacctgcagctgagagagatcgccggccacatcatggagttcagccaggaccagcacggcagcagattcatccagctgaagctggagagagccacccccgccgagagacagctggtgttcaacgagatcctgcaggccgcctaccagctgatggtggacgtgttcggcaactacgtgatccagaagttcttcgagttcggcagcctggagcagaagctggccctggccgagagaatcagaggccacgtgctgagcctggccctgcagatgtacggctgcagagtgatccagaaggccctggagttcatccccagcgaccagcaggtgatcaacgagatggtgagagagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgccctgagcacccacccctacggctgcagagtgatccagagaatcctggagcactgcctgcccgaccagaccctgcccatcctggaggagctgcaccagcacaccgagcagctggtgcaggaccagtacggcaactacgtgatccagcacgtgctggagcacggcagacccgaggacaagagcaagatcgtggccgagatcagaggcaacgtgctggtgctgagccagcacaagttcgccagcaacgtggtggagaagtgcgtgacccacgccagcagaaccgagagagccgtgctgatcgacgaggtgtgcaccatgaacgacggcccccacagcgccctgtacaccatgatgaaggaccagtacgccaactacgtggtgcagaagatgatcgacgtggccgagcccggccagagaaagatcgtgatgcacaagatcagaccccacatcgccaccctgagaaagtacacctacggcaagcacatcctggccaagctggagaagtactacatgaagaacggcgtggacctgggccccatctgcggcccccccaacggcatcatctag

SEQ ID NO: 95852 - DNA, 3567 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccggcgacaacatccacgccgagcaccaggtgagaagcatggacgagctgaaccacgacttccaggccctggccctggagggcagagccatgggcgagcagctgctgcccggcaagaagttctgggagaccgacgagagcagcaaggacggccccaagggcatcttcctgggcgaccagtggagagacagcgcctggggcaccagcgaccacagcgtgagccagcccatcatggtgcagagaagacccggccagagcttccacgtgaacagcgaggtgaacagcgtgctgagccccagaagcgagagcggcggcctgggcgtgagcatggtggagtacgtgctgagcagcagccccggcgacagctgcctgagaaagggcggcttcggccccagagacgccgacagcgacgagaacgacaagggcgagaagaagaacaagggcaccttcgacggcgacaagctgggcgacctgaaggaggagggcgacgtgatggacaagaccaacggcctgcccgtgcagaacggcatcgacgccgacgtgaaggacttcagcagaacccccggcaactgccagaacagcgccaacgaggtggacctgctgggccccaaccagaacggcagcgagggcctggcccagctgaccagcaccaacggcgccaagcccgtggaggacttcagcaacatggagagccagagcgtgcccctggaccccatggagcacgtgggcatggagcccctgcagttcgactacagcggcacccaggtgcccgtggacagcgccgccgccaccgtgggcctgttcgactacaacagccagcagcagctgttccagagacccaacgccctggccgtgcagcagctgaccgccgcccagcagcagcagtacgccctggccgccgcccaccagccccacatcggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcaggtgctgagaggcggcgccagccagagacccctgacccccaaccagaaccagcagggccagcagaccgaccccctggtggccgccgccgccgtgaacagcgccctggccttcggccagggcctggccgccggcatgcccggctaccccgtgctggcccccgccgcctactacgaccagaccggcgccctggtggtgaacgccggcgccagaaacggcctgggcgcccccgtgagactggtggcccccgcccccgtgatcatcagcagcagcgccgcccaggccgccgtggccgccgccgccgccagcgccaacggcgccgccggcggcctggccggcaccaccaacggccccttcagacccctgggcacccagcagccccagccccagccccagcagcagcccaacaacaacctggccagcagcagcttctacggcaacaacagcctgaacagcaacagccagagcagcagcctgttcagccagggcagcgcccagcccgccaacaccagcctgggcttcggcagcagcagcagcctgggcgccaccctgggcagcgccctgggcggcttcggcaccgccgtggccaacagcaacaccggcagcggcagcagaagagacagcctgaccggcagcagcgacctgtacaagagaaccagcagcagcctgacccccatcggccacagcttctacaacggcctgagcttcagcagcagccccggccccgtgggcatgcccctgcccagccagggccccggccacagccagacccccccccccagcctgagcagccacggcagcagcagcagcctgaacctgggcggcctgaccaacggcagcggcagatacatcagcgccgcccccggcgccgaggccaagtacagaagcgccagcagcgccagcagcctgttcagccccagcagcaccctgttcagcagcagcagactgagatacggcatgagcgacgtgatgcccagcggcagaagcagactgctggaggacttcagaaacaacagataccccaacctgcagctgagagagatcgccggccacatcatggagttcagccaggaccagcacggcagcagattcatccagctgaagctggagagagccacccccgccgagagacagctggtgttcaacgagatcctgcaggccgcctaccagctgatggtggacgtgttcggcaactacgtgatccagaagttcttcgagttcggcagcctggagcagaagctggccctggccgagagaatcagaggccacgtgctgagcctggccctgcagatgtacggctgcagagtgatccagaaggccctggagttcatccccagcgaccagcaggtgatcaacgagatggtgagagagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgccctgagcacccacccctacggctgcagagtgatccagagaatcctggagcactgcctgcccgaccagaccctgcccatcctggaggagctgcaccagcacaccgagcagctggtgcaggaccagtacggcaactacgtgatccagcacgtgctggagcacggcagacccgaggacaagagcaagatcgtggccgagatcagaggcaacgtgctggtgctgagccagcacaagttcgccagcaacgtggtggagaagtgcgtgacccacgccagcagaaccgagagagccgtgctgatcgacgaggtgtgcaccatgaacgacggcccccacagcgccctgtacaccatgatgaaggaccagtacgccaactacgtggtgcagaagatgatcgacgtggccgagcccggccagagaaagatcgtgatgcacaagatcagaccccacatcgccaccctgagaaagtacacctacggcaagcacatcctggccaagctggagaagtactacatgaagaacggcgtggacctgggccccatctgcggcccccccaacggcatcatctag

SEQ ID NO: 95853 - DNA, 3489 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccggcgacaacatccacgccgagcaccaggtgagaagcatggacgagctgaaccacgacttccaggccctggccctggagggcagagccatgggcgagcagctgctgcccggcaagaagttctgggagaccgacgagagcagcaaggacggccccaagggcatcttcctgggcgaccagtggagagacagcgcctggggcaccagcgaccacagcgtgagccagcccatcatggtgcagagaagacccggccagagcttccacgtgaacagcgaggtgaacagcgtgctgagccccagaagcgagagcggcggcctgggcgtgagcatggtggagtacgtgctgagcagcagccccggcgacagctgcctgagaaagggcggcttcggccccagagacgccgacagcgacgagaacgacaagggcgagaagaagaacaagggcaccttcgacggcgacaagctgggcgacctgaaggaggagggcgacgtgatggacaagaccaacggcctgcccgtgcagaacggcatcgacgccgacgtgaaggacttcagcagaacccccggcaactgccagaacagcgccaacgaggtggacctgctgggccccaaccagaacggcagcgagggcctggcccagctgaccagcaccaacggcgccaagcccgtggaggacttcagcaacatggagagccagagcgtgcccctggaccccatggagcacgtgggcatggagcccctgcagttcgactacagcggcacccaggtgcccgtggacagcgccgccgccaccgtgggcctgttcgactacaacagccagcagcagctgttccagagacccaacgccctggccgtgcagcagctgaccgccgcccagcagcagcagtacgccctggccgccgcccaccagccccacatcgccggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcaggtgctgagaggcggcgccagccagagacccctgacccccaaccagaaccagcagggccagcagaccgaccccctggtggccgccgccgccgtgaacagcgccctggccttcggccagggcctggccgccggcatgcccggctaccccgtgctggcccccgccgcctactacgaccagaccggcgccctggtggtgaacgccggcgccagaaacggcctgggcgcccccgtgagactggtggcccccgcccccgtgatcatcagcagcagcgccgcccaggccggcacccagcagccccagccccagccccagcagcagcccaacaacaacctggccagcagcagcttctacggcaacaacagcctgaacagcaacagccagagcagcagcctgttcagccagggcagcgcccagcccgccaacaccagcctgggcttcggcagcagcagcagcctgggcgccaccctgggcagcgccctgggcggcttcggcaccgccgtggccaacagcaacaccggcagcggcagcagaagagacagcctgaccggcagcagcgacctgtacaagagaaccagcagcagcctgacccccatcggccacagcttctacaacggcctgagcttcagcagcagccccggccccgtgggcatgcccctgcccagccagggccccggccacagccagacccccccccccagcctgagcagccacggcagcagcagcagcctgaacctgggcggcctgaccaacggcagcggcagatacatcagcgccgcccccggcgccgaggccaagtacagaagcgccagcagcgccagcagcctgttcagccccagcagcaccctgttcagcagcagcagactgagatacggcatgagcgacgtgatgcccagcggcagaagcagactgctggaggacttcagaaacaacagataccccaacctgcagctgagagagatcgccggccacatcatggagttcagccaggaccagcacggcagcagattcatccagctgaagctggagagagccacccccgccgagagacagctggtgttcaacgagatcctgcaggccgcctaccagctgatggtggacgtgttcggcaactacgtgatccagaagttcttcgagttcggcagcctggagcagaagctggccctggccgagagaatcagaggccacgtgctgagcctggccctgcagatgtacggctgcagagtgatccagaaggccctggagttcatccccagcgaccagcaggtgatcaacgagatggtgagagagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgccctgagcacccacccctacggctgcagagtgatccagagaatcctggagcactgcctgcccgaccagaccctgcccatcctggaggagctgcaccagcacaccgagcagctggtgcaggaccagtacggcaactacgtgatccagcacgtgctggagcacggcagacccgaggacaagagcaagatcgtggccgagatcagaggcaacgtgctggtgctgagccagcacaagttcgccagcaacgtggtggagaagtgcgtgacccacgccagcagaaccgagagagccgtgctgatcgacgaggtgtgcaccatgaacgacggcccccacagcgccctgtacaccatgatgaaggaccagtacgccaactacgtggtgcagaagatgatcgacgtggccgagcccggccagagaaagatcgtgatgcacaagatcagaccccacatcgccaccctgagaaagtacacctacggcaagcacatcctggccaagctggagaagtactacatgaagaacggcgtggacctgggccccatctgcggcccccccaacggcatcatctag

SEQ ID NO: 95854 - DNA, 291 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggctag

SEQ ID NO: 95855 - DNA, 1551 bp, Artificial Sequence
  Description of Artificial Sequence: Synthetic coding sequence
atgagcgtggcctgcgtgctgaagagaaaggccgtgctgtggcaggacagcttcagcccccacctgaagcaccacccccaggagcccgccaaccccaacatgcccgtggtgctgaccagcggcaccggcagccaggcccagccccagcccgccgccaaccaggccctggccgccggcacccacagcagccccgtgcccggcagcatcggcgtggccggcagaagccaggacgacgccatggtggactacttcttccagagacagcacggcgagcagctgggcggcggcggcagcggcggcggcggctacaacaacagcaagcacagatggcccaccggcgacaacatccacgccgagcaccaggtgagaagcatggacgagctgaaccacgacttccaggccctggccctggagggcagagccatgggcgagcagctgctgcccggcaagaagttctgggagaccgacgagagcagcaaggacggccccaagggcatcttcctgggcgaccagtggagagacagcgcctggggcaccagcgaccacagcgtgagccagcccatcatggtgcagagaagacccggccagagcttccacgtgaacagcgaggtgaacagcgtgctgagccccagaagcgagagcggcggcctgggcgtgagcatggtggagtacgtgctgagcagcagccccggcgacagctgcctgagaaagggcggcttcggccccagagacgccgacagcgacgagaacgacaagggcgagaagaagaacaagggcaccttcgacggcgacaagctgggcgacctgaaggaggagggcgacgtgatggacaagaccaacggcctgcccgtgcagaacggcatcgacgccgacgtgaaggacttcagcagaacccccggcaactgccagaacagcgccaacgaggtggacctgctgggccccaaccagaacggcagcgagggcctggcccagctgaccagcaccaacggcgccaagcccgtggaggacttcagcaacatggagagccagagcgtgcccctggaccccatggagcacgtgggcatggagcccctgcagttcgactacagcggcacccaggtgcccgtggacagcgccgccgccaccgtgggcctgttcgactacaacagccagcagcagctgttccagagacccaacgccctggccgtgcagcagctgaccgccgcccagcagcagcagtacgccctggccgccgcccaccagccccacatcggcctggcccccgccgccttcgtgcccaacccctacatcatcagcgccgccccccccggcaccgacccctacaccgccggcctggccgccgccgccaccctgggccccgccgtggtgccccaccagtactacggcgtgaccccctggggcgtgtaccccgccagcctgttccagcagcaggccgccgccgccgccgccgccaccaacagcgccaaccagcagaccaccccccaggcccagcagggccagcagcagaccgagttctgcttctgctgccccggctggagcgccatggtgtag

SEQ ID NO: 95856 - DNA, 2964 bp, Artificial Sequence
  Description of Artificial Sequence: Synthetic coding sequence
atgaaccacgacttccaggccctggccctggagagcagaggcatgggcgagctgctgcccaccaagaagttctgggagcccgacgacagcaccaaggacggccagaagggcatcttcctgggcgacgacgagtggagagagaccgcctggggcgccagccaccacagcatgagccagcccatcatggtgcagagaagaagcggccagggcttccacggcaacagcgaggtgaacgccatcctgagccccagaagcgagagcggcggcctgggcgtgagcatggtggagtacgtgctgagcagcagccccgccgacaagctggacagcagattcagaaagggcaacttcggcaccagagacgccgagaccgacggccccgagaagggcgaccagaagggcaaggccagccccttcgaggaggaccagaacagagacctgaagcagggcgacgacgacgacagcaagatcaacggcagaggcctgcccaacggcatggacgccgactgcaaggacttcaacagaacccccggcagcagacaggccagccccaccgaggtggtggagagactgggccccaacaccaaccccagcgagggcctgggccccctgcccaaccccaccgccaacaagcccctggtggaggagttcagcaaccccgagacccagaacctggacgccatggagcaggtgggcctggagagcctgcagttcgactaccccggcaaccaggtgcccatggacagcagcggcgccaccgtgggcctgttcgactacaacagccagcagcagctgttccagagaaccaacgccctgaccgtgcagcagctgaccgccgcccagcagcagcagtacgccctggccgccgcccagcagccccacatcgccggcgtgttcagcgccggcctggcccccgccgccttcgtgcccaacccctacatcatcagcgccgccccccccggcaccgacccctacaccgccgccggcctggccgccgccgccaccctggccggccccgccgtggtgcccccccagtactacggcgtgccctggggcgtgtaccccgccaacctgttccagcagcaggccgccgccgccgccaacaacaccgccagccagcaggccgccagccaggcccagcccggccagcagcaggtgctgagagccggcgccggccagagacccctgacccccaaccagggccagcagggccagcaggccgagagcctggccgccgccgccgccgccaaccccaccctggccttcggccagggcctggccaccggcatgcccggctaccaggtgctggcccccaccgcctactacgaccagaccggcgccctggtggtgggccccggcgccagaaccggcctgggcgcccccgtgagactgatggcccccacccccgtgctgatcagcagcgccgccgcccaggccgccgccgccgccgccgccggcggcaccgccagcagcctgaccggcagcaccaacggcctgttcagacccatcggcacccagcccccccagcagcagcagcagcagcccagcaccaacctgcagagcaacagcttctacggcagcagcagcctgaccaacagcagccagagcagcagcctgttcagccacggccccggccagcccggcagcaccagcctgggcttcggcagcggcaacagcctgggcgccgccatcggcagcgccctgagcggcttcggcagcagcggcggcctgaccaacggcagcggcagatacatcagcgccgcccccggcgccgaggccaagtacagaagcgccagcagcaccagcagcctgttcagcagcagcagccagctgttcccccccagcagactgagatacaacagaagcgacatcatgcccagcggcagaagcagactgctggaggacttcagaaacaacagattccccaacctgcagctgagagacctgatcggccacatcgtggagttcagccaggaccagcacggcagcagattcatccagcagaagctggagagagccacccccgccgagagacagatggtgttcaacgagatcctgcaggccgcctaccagctgatgaccgacgtgttcggcaactacgtgatccagaagttcttcgagttcggcagcctggaccagaagctggccctggccaccagaatcagaggccacgtgctgcccctggccctgcagatgtacggctgcagagtgatccagaaggccctggagagcatcagcagcgaccagcaggtgatcagcgagatggtgaaggagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgtgctgagcacccacccctacggctgcagagtgatccagagaatcctggagcactgcaccgccgagcagaccctgcccatcctggaggagctgcaccagcacaccgagcagctggtgcaggaccagtacggcaactacgtgatccagcacgtgctggagcacggcagacccgaggacaagagcaagatcgtgagcgagatcagaggcaaggtgctggccctgagccagcacaagttcgccagcaacgtggtggagaagtgcgtgacccacgccagcagagccgagagagccctgctgatcgacgaggtgtgctgccagaacgacggcccccacagcgccctgtacaccatgatgaaggaccagtacgccaactacgtggtgcagaagatgatcgacatggccgagcccgcccagagaaagatcatcatgcacaagatcagaccccacatcaccaccctgagaaagtacacctacggcaagcacatcctggccaagctggagaagtactacctgaagaacagccccgacctgggccccatcggcggcccccccaacggcatgctgtag

SEQ ID NO: 95857 - DNA, 3195 bp, Artificial Sequence
  Description of Artificial Sequence: Synthetic coding sequence
atgaaccacgacttccaggccctggccctggagagcagaggcatgggcgagctgctgcccaccaagaagttctgggagcccgacgacagcaccaaggacggccagaagggcatcttcctgggcgacgacgagtggagagagaccgcctggggcgccagccaccacagcatgagccagcccatcatggtgcagagaagaagcggccagggcttccacggcaacagcgaggtgaacgccatcctgagccccagaagcgagagcggcggcctgggcgtgagcatggtggagtacgtgctgagcagcagccccgccgacaagctggacagcagattcagaaagggcaacttcggcaccagagacgccgagaccgacggccccgagaagggcgaccagaagggcaaggccagccccttcgaggaggaccagaacagagacctgaagcagggcgacgacgacgacagcaagatcaacggcagaggcctgcccaacggcatggacgccgactgcaaggacttcaacagaacccccggcagcagacaggccagccccaccgaggtggtggagagactgggccccaacaccaaccccagcgagggcctgggccccctgcccaaccccaccgccaacaagcccctggtggaggagttcagcaaccccgagacccagaacctggacgccatggagcaggtgggcctggagagcctgcagttcgactaccccggcaaccaggtgcccatggacagcagcggcgccaccgtgggcctgttcgactacaacagccagcagcagctgttccagagaaccaacgccctgaccgtgcagcagctgaccgccgcccagcagcagcagtacgccctggccgccgcccagcagccccacatcgccggcgtgttcagcgccggcctggcccccgccgccttcgtgcccaacccctacatcatcagcgccgccccccccggcaccgacccctacaccgccgccggcctggccgccgccgccaccctggccggccccgccgtggtgcccccccagtactacggcgtgccctggggcgtgtaccccgccaacctgttccagcagcaggccgccgccgccgccaacaacaccgccagccagcaggccgccagccaggcccagcccggccagcagcaggtgctgagagccggcgccggccagagacccctgacccccaaccagggccagcagggccagcaggccgagagcctggccgccgccgccgccgccaaccccaccctggccttcggccagggcctggccaccggcatgcccggctaccaggtgctggcccccaccgcctactacgaccagaccggcgccctggtggtgggccccggcgccagaaccggcctgggcgcccccgtgagactgatggcccccacccccgtgctgatcagcagcgccgccgcccaggccgccgccgccgccgccgccggcggcaccgccagcagcctgaccggcagcaccaacggcctgttcagacccatcggcacccagcccccccagcagcagcagcagcagcccagcaccaacctgcagagcaacagcttctacggcagcagcagcctgaccaacagcagccagagcagcagcctgttcagccacggccccggccagcccggcagcaccagcctgggcttcggcagcggcaacagcctgggcgccgccatcggcagcgccctgagcggcttcggcagcagcgtgggcagcagcgccagcagcagcgccaccagaagagagagcctgagcaccagcagcgacctgtacaagagaagcagcagcagcctggcccccatcggccagcccttctacaacagcctgggcttcagcagcagccccagccccatcggcatgcccctgcccagccagacccccggccacagcctgacccccccccccagcctgagcagccacggcagcagcagcagcctgcacctgggcggcctgaccaacggcagcggcagatacatcagcgccgcccccggcgccgaggccaagtacagaagcgccagcagcaccagcagcctgttcagcagcagcagccagctgttcccccccagcagactgagatacaacagaagcgacatcatgcccagcggcagaagcagactgctggaggacttcagaaacaacagattccccaacctgcagctgagagacctgatcggccacatcgtggagttcagccaggaccagcacggcagcagattcatccagcagaagctggagagagccacccccgccgagagacagatggtgttcaacgagatcctgcaggccgcctaccagctgatgaccgacgtgttcggcaactacgtgatccagaagttcttcgagttcggcagcctggaccagaagctggccctggccaccagaatcagaggccacgtgctgcccctggccctgcagatgtacggctgcagagtgatccagaaggccctggagagcatcagcagcgaccagcagagcgagatggtgaaggagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgtgctgagcacccacccctacggctgcagagtgatccagagaatcctggagcactgcaccgccgagcagaccctgcccatcctggaggagctgcaccagcacaccgagcagctggtgcaggaccagtacggcaactacgtgatccagcacgtgctggagcacggcagacccgaggacaagagcaagatcgtgagcgagatcagaggcaaggtgctggccctgagccagcacaagttcgccagcaacgtggtggagaagtgcgtgacccacgccagcagagccgagagagccctgctgatcgacgaggtgtgctgccagaacgacggcccccacagcgccctgtacaccatgatgaaggaccagtacgccaactacgtggtgcagaagatgatcgacatggccgagcccgcccagagaaagatcatcatgcacaagatcagaccccacatcaccaccctgagaaagtacacctacggcaagcacatcctggccaagctggagaagtactacctgaagaacagccccgacctgggccccatcggcggcccccccaacggcatgctgtag

SEQ ID NO: 95858 - DNA, 3201 bp, Artificial Sequence
  Description of Artificial Sequence: Synthetic coding sequence
atgaaccacgacttccaggccctggccctggagagcagaggcatgggcgagctgctgcccaccaagaagttctgggagcccgacgacagcaccaaggacggccagaagggcatcttcctgggcgacgacgagtggagagagaccgcctggggcgccagccaccacagcatgagccagcccatcatggtgcagagaagaagcggccagggcttccacggcaacagcgaggtgaacgccatcctgagccccagaagcgagagcggcggcctgggcgtgagcatggtggagtacgtgctgagcagcagccccgccgacaagctggacagcagattcagaaagggcaacttcggcaccagagacgccgagaccgacggccccgagaagggcgaccagaagggcaaggccagccccttcgaggaggaccagaacagagacctgaagcagggcgacgacgacgacagcaagatcaacggcagaggcctgcccaacggcatggacgccgactgcaaggacttcaacagaacccccggcagcagacaggccagccccaccgaggtggtggagagactgggccccaacaccaaccccagcgagggcctgggccccctgcccaaccccaccgccaacaagcccctggtggaggagttcagcaaccccgagacccagaacctggacgccatggagcaggtgggcctggagagcctgcagttcgactaccccggcaaccaggtgcccatggacagcagcggcgccaccgtgggcctgttcgactacaacagccagcagcagctgttccagagaaccaacgccctgaccgtgcagcagctgaccgccgcccagcagcagcagtacgccctggccgccgcccagcagccccacatcgccggcgtgttcagcgccggcctggcccccgccgccttcgtgcccaacccctacatcatcagcgccgccccccccggcaccgacccctacaccgccgccggcctggccgccgccgccaccctggccggccccgccgtggtgcccccccagtactacggcgtgccctggggcgtgtaccccgccaacctgttccagcagcaggccgccgccgccgccaacaacaccgccagccagcaggccgccagccaggcccagcccggccagcagcaggtgctgagagccggcgccggccagagacccctgacccccaaccagggccagcagggccagcaggccgagagcctggccgccgccgccgccgccaaccccaccctggccttcggccagggcctggccaccggcatgcccggctaccaggtgctggcccccaccgcctactacgaccagaccggcgccctggtggtgggccccggcgccagaaccggcctgggcgcccccgtgagactgatggcccccacccccgtgctgatcagcagcgccgccgcccaggccgccgccgccgccgccgccggcggcaccgccagcagcctgaccggcagcaccaacggcctgttcagacccatcggcacccagcccccccagcagcagcagcagcagcccagcaccaacctgcagagcaacagcttctacggcagcagcagcctgaccaacagcagccagagcagcagcctgttcagccacggccccggccagcccggcagcaccagcctgggcttcggcagcggcaacagcctgggcgccgccatcggcagcgccctgagcggcttcggcagcagcgtgggcagcagcgccagcagcagcgccaccagaagagagagcctgagcaccagcagcgacctgtacaagagaagcagcagcagcctggcccccatcggccagcccttctacaacagcctgggcttcagcagcagccccagccccatcggcatgcccctgcccagccagacccccggccacagcctgacccccccccccagcctgagcagccacggcagcagcagcagcctgcacctgggcggcctgaccaacggcagcggcagatacatcagcgccgcccccggcgccgaggccaagtacagaagcgccagcagcaccagcagcctgttcagcagcagcagccagctgttcccccccagcagactgagatacaacagaagcgacatcatgcccagcggcagaagcagactgctggaggacttcagaaacaacagattccccaacctgcagctgagagacctgatcggccacatcgtggagttcagccaggaccagcacggcagcagattcatccagcagaagctggagagagccacccccgccgagagacagatggtgttcaacgagatcctgcaggccgcctaccagctgatgaccgacgtgttcggcaactacgtgatccagaagttcttcgagttcggcagcctggaccagaagctggccctggccaccagaatcagaggccacgtgctgcccctggccctgcagatgtacggctgcagagtgatccagaaggccctggagagcatcagcagcgaccagcaggtgatcagcgagatggtgaaggagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgtgctgagcacccacccctacggctgcagagtgatccagagaatcctggagcactgcaccgccgagcagaccctgcccatcctggaggagctgcaccagcacaccgagcagctggtgcaggaccagtacggcaactacgtgatccagcacgtgctggagcacggcagacccgaggacaagagcaagatcgtgagcgagatcagaggcaaggtgctggccctgagccagcacaagttcgccagcaacgtggtggagaagtgcgtgacccacgccagcagagccgagagagccctgctgatcgacgaggtgtgctgccagaacgacggcccccacagcgccctgtacaccatgatgaaggaccagtacgccaactacgtggtgcagaagatgatcgacatggccgagcccgcccagagaaagatcatcatgcacaagatcagaccccacatcaccaccctgagaaagtacacctacggcaagcacatcctggccaagctggagaagtactacctgaagaacagccccgacctgggccccatcggcggcccccccaacggcatgctgtag

SEQ ID NO: 95859 - DNA, 3195 bp, Artificial Sequence; identical to SEQ ID NO: 95857
  Description of Artificial Sequence: Synthetic coding sequence

SEQ ID NO: 95860 - DNA, 105 bp, Artificial Sequence
  Description of Artificial Sequence: Synthetic coding sequence
atgaaccacgacttccaggccctggccctggagagcagaggcatgggcgagctgctgcccaccaagaagttctgggagcccgacgacagcaccaaggacggctag

SEQ ID NO: 95861 - DNA, 882 bp, Artificial Sequence
  Description of Artificial Sequence: Synthetic coding sequence
atgaaccacgacttccaggccctggccctggagagcagaggcatgggcgagctgctgcccaccaagaagttctgggagcccgacgacagcaccaaggacggccagaagggcatcttcctgggcgacgacgagtggagagagaccgcctggggcgccagccaccacagcatgagccagcccatcatggtgcagagaagaagcggccagggcttccacggcaacagcgaggtgaacgccatcctgagccccagaagcgagagcggcggcctgggcgtgagcatggtggagtacgtgctgagcagcagccccgccgacaagctggacagcagattcagaaagggcaacttcggcaccagagacgccgagaccgacggccccgagaagggcgaccagaagggcaaggccagccccttcgaggaggaccagaacagagacctgaagcagggcgacgacgacgacagcaagatcaacggcagaggcctgcccaacggcatggacgccgactgcaaggacttcaacagaacccccggcagcagacaggccagccccaccgaggtggtggagagactgggccccaacaccaaccccagcgagggcctgggccccctgcccaaccccaccgccaacaagcccctggtggaggagttcagcaaccccgagacccagaacctggacgccatggagcaggtgggcctggagagcctgcagttcgactaccccggcaaccaggtgcccatggacagcagcggcgccaccgtgggcctgttcgactacaacagccagcagcagctgttccagagaaccaacgccctgaccgtgcagcagctgaccgccgcccagcagcagcagtacgccctggccgccgcccagcagccccactag

SEQ ID NO: 95862 - DNA, 3027 bp, Artificial Sequence
  Description of Artificial Sequence: Synthetic coding sequence
atgagccagcccatcatggtgcagagaagaagcggccagggcttccacggcaacagcgaggtgaacgccatcctgagccccagaagcgagagcggcggcctgggcgtgagcatggtggagtacgtgctgagcagcagccccgccgacaagctggacagcagattcagaaagggcaacttcggcaccagagacgccgagaccgacggccccgagaagggcgaccagaagggcaaggccagccccttcgaggaggaccagaacagagacctgaagcagggcgacgacgacgacagcaagatcaacggcagaggcctgcccaacggcatggacgccgactgcaaggacttcaacagaacccccggcagcagacaggccagccccaccgaggtggtggagagactgggccccaacaccaaccccagcgagggcctgggccccctgcccaaccccaccgccaacaagcccctggtggaggagttcagcaaccccgagacccagaacctggacgccatggagcaggtgggcctggagagcctgcagttcgactaccccggcaaccaggtgcccatggacagcagcggcgccaccgtgggcctgttcgactacaacagccagcagcagctgttccagagaaccaacgccctgaccgtgcagcagctgaccgccgcccagcagcagcagtacgccctggccgccgcccagcagccccacatcgccggcgtgttcagcgccggcctggcccccgccgccttcgtgcccaacccctacatcatcagcgccgccccccccggcaccgacccctacaccgccgccggcctggccgccgccgccaccctggccggccccgccgtggtgcccccccagtactacggcgtgccctggggcgtgtaccccgccaacctgttccagcagcaggccgccgccgccgccaacaacaccgccagccagcaggccgccagccaggcccagcccggccagcagcaggtgctgagagccggcgccggccagagacccctgacccccaaccagggccagcagggccagcaggccgagagcctggccgccgccgccgccgccaaccccaccctggccttcggccagggcctggccaccggcatgcccggctaccaggtgctggcccccaccgcctactacgaccagaccggcgccctggtggtgggccccggcgccagaaccggcctgggcgcccccgtgagactgatggcccccacccccgtgctgatcagcagcgccgccgcccaggccgccgccgccgccgccgccggcggcaccgccagcagcctgaccggcagcaccaacggcctgttcagacccatcggcacccagcccccccagcagcagcagcagcagcccagcaccaacctgcagagcaacagcttctacggcagcagcagcctgaccaacagcagccagagcagcagcctgttcagccacggccccggccagcccggcagcaccagcctgggcttcggcagcggcaacagcctgggcgccgccatcggcagcgccctgagcggcttcggcagcagcgtgggcagcagcgccagcagcagcgccaccagaagagagagcctgagcaccagcagcgacctgtacaagagaagcagcagcagcctggcccccatcggccagcccttctacaacagcctgggcttcagcagcagccccagccccatcggcatgcccctgcccagccagacccccggccacagcctgacccccccccccagcctgagcagccacggcagcagcagcagcctgcacctgggcggcctgaccaacggcagcggcagatacatcagcgccgcccccggcgccgaggccaagtacagaagcgccagcagcaccagcagcctgttcagcagcagcagccagctgttcccccccagcagactgagatacaacagaagcgacatcatgcccagcggcagaagcagactgctggaggacttcagaaacaacagattccccaacctgcagctgagagacctgatcggccacatcgtggagttcagccaggaccagcacggcagcagattcatccagcagaagctggagagagccacccccgccgagagacagatggtgttcaacgagatcctgcaggccgcctaccagctgatgaccgacgtgttcggcaactacgtgatccagaagttcttcgagttcggcagcctggaccagaagctggccctggccaccagaatcagaggccacgtgctgcccctggccctgcagatgtacggctgcagagtgatccagaaggccctggagagcatcagcagcgaccagcagagcgagatggtgaaggagctggacggccacgtgctgaagtgcgtgaaggaccagaacggcaaccacgtggtgcagaagtgcatcgagtgcgtgcagccccagagcctgcagttcatcatcgacgccttcaagggccaggtgttcgtgctgagcacccacccctacggctgcagagtgatccagagaatcctggagcactgcaccgccgagcagaccctgcccatcctggaggagctgcaccagcacaccgagcagctggtgcaggaccagtacggcaactacgtgatccagcacgtgctggagcacggcagacccgaggacaagagcaagatcgtgagcgagatcagaggcaaggtgctggccctgagccagcacaagttcgccagcaacgtggtggagaagtgcgtgacccacgccagcagagccgagagagccctgctgatcgacgaggtgtgctgccagaacgacggcccccacagcgccctgtacaccatgatgaaggaccagtacgccaactacgtggtgcagaagatgatcgacatggccgagcccgcccagagaaagatcatcatgcacaagatcagaccccacatcaccaccctgagaaagtacacctacggcaagcacatcctggccaagctggagaagtactacctgaagaacagccccgacctgggccccatcggcggcccccccaacggcatgctgtag

SEQ ID NO: 95863 - DNA, 870 bp, Artificial Sequence
  Description of Artificial Sequence: Synthetic coding sequence
atggagaacggctacacctacgaggactacaagaacaccgccgagtggctgctgagccacaccaagcacagaccccaggtggccatcatctgcggcagcggcctgggcggcctgaccgacaagctgacccaggcccagatcttcgactacggcgagatccccaacttccccagaagcaccgtgcccggccacgccggcagactggtgttcggcttcctgaacggcagagcctgcgtgatgatgcagggcagattccacatgtacgagggctaccccctgtggaaggtgaccttccccgtgagagtgttccacctgctgggcgtggacaccctggtggtgaccaacgccgccggcggcctgaaccccaagttcgaggtgggcgacatcatgctgatcagagaccacatcaacctgcccggcttcagcggccagaaccccctgagaggccccaacgacgagagattcggcgacagattccccgccatgagcgacgcctacgacagaaccatgagacagagagccctgagcacctggaagcagatgggcgagcagagagagctgcaggagggcacctacgtgatggtggccggccccagcttcgagaccgtggccgagtgcagagtgctgcagaagctgggcgccgacgccgtgggcatgagcaccgtgcccgaggtgatcgtggccagacactgcggcctgagagtgttcggcttcagcctgatcaccaacaaggtgatcatggactacgagagcctggagaaggccaaccacgaggaggtgctggccgccggcaagcaggccgcccagaagctggagcagttcgtgagcatcctgatggccagcatccccctgcccgacaaggccagctag

SEQ ID NO: 95864 - DNA, 282 bp, Artificial Sequence
  Description of Artificial Sequence: Synthetic coding sequence
atggagaacggctacacctacgaggactacaagaacaccgccgagtggctgctgagccacaccaagcacagaccccaggtggccatcatctgcggcagcggcctgggcggcctgaccgacaagctgacccaggcccagatcttcgactacggcgagatccccaacttccccagaagcaccgtgcccggccacgccggcagactggtgttcggcttcctgaacggcagagcctgcgtgatgatgcagggcagattccacatgtacgagggctaccccctgtag

SEQ ID NO: 95865 - DNA, 375 bp, Artificial Sequence
  Description of Artificial Sequence: Synthetic coding sequence
atgagctacatccccggccagcccgtgaccgccgtggtgcagagagtggagatccacaagctgagacagggcgagaacctgatcctgggcttcagcatcggcggcggcatcgaccaggaccccagccagaaccccttcagcgaggacaagaccgacaagggcatctacgtgaccagagtgagcgagggcggccccgccgagatcgccggcctgcagatcggcgacaagatcatgcaggtgaacggctgggacatgaccatggtgacccacgaccaggccagaaagagactgaccaagagaagcgaggaggtggtgagactgctggtgaccagacagagcctgcagaaggccgtgcagcagagcatgctgagctag

SEQ ID NO: 95866 - DNA, 1194 bp, Artificial Sequence
  Description of Artificial Sequence: Synthetic coding sequence
atgaactgcatcagcgacttcttcacctacgagaccaccaagagcgtggtggtgaagagctggaccatcggcatcatcaacagagtggtgcagctgctgatcatcagctacttcgtgggctgggtgttcctgcacgagaaggcctaccaggtgagagacaccgccatcgagagcagcgtggtgaccaaggtgaagggcagcggcctgtacgccaacagagtgatggacgtgagcgactacgtgacccccccccagggcaccagcgtgttcgtgatcatcaccaagatgatcgtgaccgagaaccagatgcagggcttctgccccgagagcgaggagaagtacagatgcgtgagcgacagccagtgcggccccgagagactgcccggcggcggcatcctgaccggcagatgcgtgaactacagcagcgtgctgagaacctgcgagatccagggctggtgccccaccgaggtggacaccgtggagacccccatcatgatggaggccgagaacttcaccatcttcatcaagaacagcatcagattccccctgttcaacttcgagaagggcaacctgctgcccaacctgaccgccagagacatgaagacctgcagattccaccccgacaaggaccccttctgccccatcctgagagtgggcgacgtggtgaagttcgccggccaggacttcgccaagctggccagaaccggcggcgtgctgggcatcaagatcggctgggtgtgcgacctggacaaggcctgggaccagtgcatccccaagtacagcttcaccagactggacagcgtgagcgagaagagcagcgtgagccccggctacaacttcagattcgccaagtactacaagatggagaacggcagcgagtacagaaccctgctgaaggccttcggcatcagattcgacgtgctggtgtacggcaacgccggcaagttcaacatcatccccaccatcatcagcagcgtggccgccttcaccagcgtgggcgtgggcaccgtgctgtgcgacatcatcctgctgaacttcctgaagggcgccgaccagtacaaggccaagaagttcgaggaggtgaacgagaccaccctgaagatcgccgccctgaccaaccccgtgtaccccagcgaccagaccaccgccgagaagcagagcaccgacagcggcgccttcagcatcggccactag

SEQ ID NO: 95867 - DNA, 1191 bp, Artificial Sequence
  Description of Artificial Sequence: Synthetic coding sequence
atgaactgcatcagcgacttcttcacctacgagaccaccaagagcgtggtggtgaagagctggaccatcggcatcatcaacagagtggtgcagctgctgatcatcagctacttcgtgggctgggtgttcctgcacgagaaggcctaccaggtgagagacaccgccatcgagagcagcgtggtgaccaaggtgaagggcagcggcctgtacgccaacagagtgatggacgtgagcgactacgtgacccccccccagggcaccagcgtgttcgtgatcatcaccaagatgatcgtgaccgagaaccagatgcagggcttctgccccgagagcgaggagaagtacagatgcgtgagcgacagccagtgcggccccgagagactgcccggcggcggcatcctgaccggcagatgcgtgaactacagcagcgtgctgagaacctgcgagatccagggctggtgccccaccgaggtggacaccgtggagacccccatcatgatggaggccgagaacttcaccatcttcatcaagaacagcatcagattccccctgttcaacttcgagaagggcaacctgctgcccaacctgaccgccagagacatgaagacctgcagattccaccccgacaaggaccccttctgccccatcctgagagtgggcgacgtggtgaagttcgccggccaggacttcgccaagctggccagaaccggcggcgtgctgggcatcaagatcggctgggtgtgcgacctggacaaggcctgggaccagtgcatccccaagtacagcttcaccagactggacagcgtgagcgagaagagcagcgtgagccccggctacaacttcagattcgccaagtactacaagatggagaacggcagcgagtacagaaccctgctgaaggccttcggcatcagattcgacgtgctgtacaccggcgccggcaagttcaacatcatccccaccatcatcagcagcgtggccgccttcaccagcgtgggcgtgggcaccgtgctgtgcgacatcatcctgctgaacttcctgaagggcgccgaccagtacaaggccaagaagttcgaggaggtgaacgagaccaccctgaagatcgccgccctgaccaaccccgtgtaccccagcgaccagaccaccgccgagaagcagagcaccgacagcggcgccttcagcatcggccactag

SEQ ID NO: 95868 - DNA, 1167 bp, Artificial Sequence
  Description of Artificial Sequence: Synthetic coding sequence
atggccggctgctgcgccgccctggccgccttcctgttcgagtacgacacccccagaatcgtgctgatcagaagcagaaaggtgggcctgatgaacagagccgtgcagctgctgatcctggcctacgtgatcggctgggtgttcgtgtgggagaagggctaccaggagaccgacagcgtggtgagcagcgtgaccaccaaggtgaagggcgtggccgtgaccaacaccagcaagctgggcttcagaatctgggacgtggccgactacgtgatccccgcccaggaggagaacagcctgttcgtgatgaccaacgtgatcctgaccatgaaccagacccagggcctgtgccccgagatccccgacgccaccaccgtgtgcaagagcgacgccagctgcaccgccggcagcgccggcacccacagcaacggcgtgagcaccggcagatgcgtggccttcaacggcagcgtgaagacctgcgaggtggccgcctggtgccccgtggaggacgacacccacgtgccccagcccgccttcctgaaggccgccgagaacttcaccctgctggtgaagaacaacatctggtaccccaagttcaacttcagcaagagaaacatcctgcccaacatcaccaccacctacctgaagagctgcatctacgacgccaagaccgaccccttctgccccatcttcagactgggcaagatcgtggagaacgccggccacagcttccaggacatggccgtggagggcggcatcatgggcatccaggtgaactgggactgcaacctggacagagccgccagcctgtgcctgcccagatacagcttcagaagactggacaccagagacgtggagcacaacgtgagccccggctacaacttcagattcgccaagtactacagagacctggccggcaacgagcagagaaccctgatcaaggcctacggcatcagattcgacatcatcgtgttcggcaaggccggcaagttcgacatcatccccaccatgatcaacatcggcagcggcctggccctgctgggcatggccaccgtgctgtgcgacatcatcgtgctgtactgcatgaagaagagactgtactacagagagaagaagtacaagtacgtggaggactacgagcagggcctggccagcgagctggaccagtag

SEQ ID NO: 95869 - DNA, 1215 bp, Artificial Sequence
  Description of Artificial Sequence: Synthetic coding sequence
atggccggctgctgcgccgccctggccgccttcctgttcgagtacgacacccccagaatcgtgctgatcagaagcagaaaggtgggcctgatgaacagagccgtgcagctgctgatcctggcctacgtgatcggctgctaccacccccacctggccgaggtggagatggagagccccagaagatgggtgttcgtgtgggagaagggctaccaggagaccgacagcgtggtgagcagcgtgaccaccaaggtgaagggcgtggccgtgaccaacaccagcaagctgggcttcagaatctgggacgtggccgactacgtgatccccgcccaggaggagaacagcctgttcgtgatgaccaacgtgatcctgaccatgaaccagacccagggcctgtgccccgagatccccgacgccaccaccgtgtgcaagagcgacgccagctgcaccgccggcagcgccggcacccacagcaacggcgtgagcaccggcagatgcgtggccttcaacggcagcgtgaagacctgcgaggtggccgcctggtgccccgtggaggacgacacccacgtgccccagcccgccttcctgaaggccgccgagaacttcaccctgctggtgaagaacaacatctggtaccccaagttcaacttcagcaagagaaacatcctgcccaacatcaccaccacctacctgaagagctgcatctacgacgccaagaccgaccccttctgccccatcttcagactgggcaagatcgtggagaacgccggccacagcttccaggacatggccgtggagggcggcatcatgggcatccaggtgaactgggactgcaacctggacagagccgccagcctgtgcctgcccagatacagcttcagaagactggacaccagagacgtggagcacaacgtgagccccggctacaacttcagattcgccaagtactacagagacctggccggcaacgagcagagaaccctgatcaaggcctacggcatcagattcgacatcatcgtgttcggcaaggccggcaagttcgacatcatccccaccatgatcaacatcggcagcggcctggccctgctgggcatggccaccgtgctgtgcgacatcatcgtgctgtactgcatgaagaagagactgtactacagagagaagaagtacaagtacgtggaggactacgagcagggcctggccagcgagctggaccagtag

SEQ ID NO: 95870 - DNA, 441 bp, Artificial Sequence
  Description of Artificial Sequence: Synthetic coding sequence
atggccggctgctgcgccgccctggccgccttcctgttcgagtacgacacccccagaatcgtgctgatcagaagcagaaaggtgggcctgatgaacagagccgtgcagctgctgatcctggcctacgtgatcggctgggtgttcgtgtgggagaagggctaccaggagaccgacagcgtggtgagcagcgtgaccaccaaggtgaagggcgtggccgtgaccaacaccagcaagctgggcttcagaatctgggacgtggccgactacgtgatccccgcccaggaggagaacagcctgttcgtgatgaccaacgtgatcctgaccatgaaccagacccagggcctgtgccccgagatccccgacgccaccaccgtgtgcaagagcgacgccagctgcaccgccggcagcgccggcacccacagcaacgacctgctgttctag

SEQ ID NO: 95871 - DNA, 1086 bp, Artificial Sequence
  Description of Artificial Sequence: Synthetic coding sequence
atggccggctgctgcgccgccctggccgccttcctgttcgagtacgacacccccagaatcgtgctgatcagaagcagaaaggtgggcctgatgaacagagccgtgcagctgctgatcctggcctacgtgatcggctgggtgttcgtgtgggagaagggctaccaggagaccgacagcgtggtgagcagcgtgaccaccaaggtgaagggcgtggccgtgaccaacaccagcaagctgggcttcagaatctgggacgtggccgactacgtgatccccgcccaggaggagaacagcctgttcgtgatgaccaacgtgatcctgaccatgaaccagacccagggcctgtgccccgagatccccgacgccaccaccgtgtgcaagagcgacgccagctgcaccgccggcagcgccggcacccacagcaacggcgtgagcaccggcagacccgccttcctgaaggccgccgagaacttcaccctgctggtgaagaacaacatctggtaccccaagttcaacttcagcaagagaaacatcctgcccaacatcaccaccacctacctgaagagctgcatctacgacgccaagaccgaccccttctgccccatcttcagactgggcaagatcgtggagaacgccggccacagcttccaggacatggccgtggagggcggcatcatgggcatccaggtgaactgggactgcaacctggacagagccgccagcctgtgcctgcccagatacagcttcagaagactggacaccagagacgtggagcacaacgtgagccccggctacaacttcagattcgccaagtactacagagacctggccggcaacgagcagagaaccctgatcaaggcctacggcatcagattcgacatcatcgtgttcggcaaggccggcaagttcgacatcatccccaccatgatcaacatcggcagcggcctggccctgctgggcatggccaccgtgctgtgcgacatcatcgtgctgtactgcatgaagaagagactgtactacagagagaagaagtacaagtacgtggaggactacgagcagggcctggccagcgagctggaccagtag

SEQ ID NO: 95872 - DNA, 864 bp, Artificial Sequence
  Description of Artificial Sequence: Synthetic coding sequence
atgaccaacgtgatcctgaccatgaaccagacccagggcctgtgccccgagatccccgacgccaccaccgtgtgcaagagcgacgccagctgcaccgccggcagcgccggcacccacagcaacggcgtgagcaccggcagatgcgtggccttcaacggcagcgtgaagacctgcgaggtggccgcctggtgccccgtggaggacgacacccacgtgccccagcccgccttcctgaaggccgccgagaacttcaccctgctggtgaagaacaacatctggtaccccaagttcaacttcagcaagagaaacatcctgcccaacatcaccaccacctacctgaagagctgcatctacgacgccaagaccgaccccttctgccccatcttcagactgggcaagatcgtggagaacgccggccacagcttccaggacatggccgtggagggcggcatcatgggcatccaggtgaactgggactgcaacctggacagagccgccagcctgtgcctgcccagatacagcttcagaagactggacaccagagacgtggagcacaacgtgagccccggctacaacttcagattcgccaagtactacagagacctggccggcaacgagcagagaaccctgatcaaggcctacggcatcagattcgacatcatcgtgttcggcaaggccggcaagttcgacatcatccccaccatgatcaacatcggcagcggcctggccctgctgggcatggccaccgtgctgtgcgacatcatcgtgctgtactgcatgaagaagagactgtactacagagagaagaagtacaagtacgtggaggactacgagcagggcctggccagcgagctggaccagtag

SEQ ID NO: 95873 - DNA, 1278 bp, Artificial Sequence
  Description of Artificial Sequence: Synthetic coding sequence
atggacggccccgccgagcagagacccgccctgctgaacagcgccgagaacttcaccgtgctgatcaagaacaacatcgacttccccggccacaactacaccaccagaaacatcctgcccggcctgaacatcacctgcaccttccacaagacccagaacccccagtgccccatcttcagactgggcgacatcttcagagagaccggcgacaacttcagcgacgtggccatccagggcggcatcatgggcatcgagatctactgggactgcaacctggacagatggttccaccactgcagacccaagtacagcttcagaagactggacgacaagaccaccaacgtgagcctgtaccccggctacaacttcagatacgccaagtactacaaggagaacaacgtggagaagagaaccctgatcaaggtgttcggcatcagattcgacatcctggtgttcggcaccggcggcaagttcgacatcatccagctggtggtgtacatcggcagcaccctgagctacttcggcctggccgccgtgttcatcgacttcctgatcgacacctacagcagcaactgctgcagaagccacatctacccctggtgcaagtgctgccagccctgcgtggtgaacgagtactactacagaaagaagtgcgagagcatcgtggagcccaagcccaccctgaagtacgtgagcttcgtggacgagagccacatcagaatggtgaaccagcagctgctgggcagaagcctgcaggacgtgaagggccaggaggtgcccagacccgccatggacttcaccgacctgagcagactgcccctggccctgcacgacaccccccccatccccggccagcccgaggagatccagctgctgagaaaggaggccacccccagaagcagagacagccccgtgtggtgccagtgcggcagctgcctgcccagccagctgcccgagagccacagatgcctggaggagctgtgctgcagaaagaagcccggcgcctgcatcaccaccagcgagctgttcagaaagctggtgctgagcagacacgtgctgcagttcctgctgctgtaccaggagcccctgctggccctggacgtggacagcaccaacagcagactgagacactgcgcctacagatgctacgccacctggagattcggcagccaggacatggccgacttcgccaacctgcccagctgctgcagatggagaatcagaaaggagttccccaagagcgagggccagtacagcggcttcaagagcccctactag

SEQ ID NO: 95874 - DNA, 828 bp, Artificial Sequence
  Description of Artificial Sequence: Synthetic coding sequence
atgcccgcctgctgcagctgcagcgacgtgttccagtacgagaccaacaaggtgaccagaatccagagcatgaactacggcaccatcaagtggttcttccacgtgatcatcttcagctacgtgtgcttcgccctggtgagcgacaagctgtaccagagaaaggagcccgtgatcagcagcgtgcacaccaaggtgaagggcatcgccgaggtgaaggaggagatcgtggagaacggcgtgaagaagctggtgcacagcgtgttcgacaccgccgactacaccttccccctgcagggcaacagcttcttcgtgatgaccaacttcctgaagaccgagggccaggagcagagactgtgccccgagtaccccaccagaagaaccctgtgcagcagcgacagaggctgcaagaagggctggatggacccccagagcaagggcatccagaccggcagatgcgtggtgtacgagggcaaccagaagacctgcgaggtgagcgcctggtgccccatcgaggccgtggaggaggcccccagacccgccctgctgaacagcgccgagaacttcaccgtgctgatcaagaacaacatcgacttccccggccacaactacaccacctacgccaagtactacaaggagaacaacgtggagaagagaaccctgatcaaggtgttcggcatcagattcgacatcctggtgttcggcaccggcggcaagttcgacatcatccagctggtggtgtacatcggcagcaccctgagctacttcggcctggtgagagacagcctgttccacgccctgggcaagtggttcggcgagggcagcgactag

SEQ ID NO: 95875 - DNA, 1518 bp, Artificial Sequence
  Description of Artificial Sequence: Synthetic coding sequence
atgacccccggcgaccacagctggggcaacagcttcttcgtgatgaccaacttcctgaagaccgagggccaggagcagagactgtgccccgagtaccccaccagaagaaccctgtgcagcagcgacagaggctgcaagaagggctggatggacccccagagcaagggcatccagaccggcagatgcgtggtgtacgagggcaaccagaagacctgcgaggtgagcgcctggtgccccatcgaggccgtggaggaggcccccagacccgccctgctgaacagcgccgagaacttcaccgtgctgatcaagaacaacatcgacttccccggccacaactacaccaccagaaacatcctgcccggcctgaacatcacctgcaccttccacaagacccagaacccccagtgccccatcttcagactgggcgacatcttcagagagaccggcgacaacttcagcgacgtggccatccagggcggcatcatgggcatcgagatctactgggactgcaacctggacagatggttccaccactgcagacccaagtacagcttcagaagactggacgacaagaccaccaacgtgagcctgtaccccggctacaacttcagatacgccaagtactacaaggagaacaacgtggagaagagaaccctgatcaaggtgttcggcatcagattcgacatcctggtgttcggcaccggcggcaagttcgacatcatccagctggtggtgtacatcggcagcaccctgagctacttcggcctggccgccgtgttcatcgacttcctgatcgacacctacagcagcaactgctgcagaagccacatctacccctggtgcaagtgctgccagccctgcgtggtgaacgagtactactacagaaagaagtgcgagagcatcgtggagcccaagcccaccctgaagtacgtgagcttcgtggacgagagccacatcagaatggtgaaccagcagctgctgggcagaagcctgcaggacgtgaagggccaggaggtgcccagacccgccatggacttcaccgacctgagcagactgcccctggccctgcacgacaccccccccatccccggccagcccgaggagatccagctgctgagaaaggaggccacccccagaagcagagacagccccgtgtggtgccagtgcggcagctgcctgcccagccagctgcccgagagccacagatgcctggaggagctgtgctgcagaaagaagcccggcgcctgcatcaccaccagcgagctgttcagaaagctggtgctgagcagacacgtgctgcagttcctgctgctgtaccaggagcccctgctggccctggacgtggacagcaccaacagcagactgagacactgcgcctacagatgctacgccacctggagattcggcagccaggacatggccgacttcgccaacctgcccagctgctgcagatggagaatcagaaaggagttccccaagagcgagggccagtacagcggcttcaagagcccctactag

SEQ ID NO: 95876 - DNA, 387 bp, Artificial Sequence
  Description of Artificial Sequence: Synthetic coding sequence
atgcccgcctgctgcagctgcagcgacgtgttccagtacgagaccaacaaggtgaccagaatccagagcatgaactacggcaccatcaagtggttcttccacgtgatcatcttcagctacgtgtgcttcgccctggtgagcgacaagctgtaccagagaaaggagcccgtgatcagcagcgtgcacaccaaggtgaagggcatcgccgaggtgaaggaggagatcgtggagaacggcgtgaagaagctggtgcacagcgtgttcgacaccgccgactacaccttccccctgcagggcaacagcttcttcgtgatgaccaacttcctgaagaccgagggccaggagcagagactgtgccccgaggagttcagacccgagggcgtgtag

SEQ ID NO: 95877 - DNA, 921 bp, Artificial Sequence
  Description of Artificial Sequence: Synthetic coding sequence
atgtggcagttcagatacgccaagtactacaaggagaacaacgtggagaagagaaccctgatcaaggtgttcggcatcagattcgacatcctggtgttcggcaccggcggcaagttcgacatcatccagctggtggtgtacatcggcagcaccctgagctacttcggcctggccgccgtgttcatcgacttcctgatcgacacctacagcagcaactgctgcagaagccacatctacccctggtgcaagtgctgccagccctgcgtggtgaacgagtactactacagaaagaagtgcgagagcatcgtggagcccaagcccaccctgaagtacgtgagcttcgtggacgagagccacatcagaatggtgaaccagcagctgctgggcagaagcctgcaggacgtgaagggccaggaggtgcccagacccgccatggacttcaccgacctgagcagactgcccctggccctgcacgacaccccccccatccccggccagcccgaggagatccagctgctgagaaaggaggccacccccagaagcagagacagccccgtgtggtgccagtgcggcagctgcctgcccagccagctgcccgagagccacagatgcctggaggagctgtgctgcagaaagaagcccggcgcctgcatcaccaccagcgagctgttcagaaagctggtgctgagcagacacgtgctgcagttcctgctgctgtaccaggagcccctgctggccctggacgtggacagcaccaacagcagactgagacactgcgcctacagatgctacgccacctggagattcggcagccaggacatggccgacttcgccaacctgcccagctgctgcagatggagaatcagaaaggagttccccaagagcgagggccagtacagcggcttcaagagcccctactag

SEQ ID NO: 95878 - DNA, 387 bp, Artificial Sequence; identical to SEQ ID NO: 95876
  Description of Artificial Sequence: Synthetic coding sequence

SEQ ID NO: 95879 - DNA, 1788 bp, Artificial Sequence
  Description of Artificial Sequence: Synthetic coding sequence
atgcccgcctgctgcagctgcagcgacgtgttccagtacgagaccaacaaggtgaccagaatccagagcatgaactacggcaccatcaagtggttcttccacgtgatcatcttcagctacgtgtgcttcgccctggtgagcgacaagctgtaccagagaaaggagcccgtgatcagcagcgtgcacaccaaggtgaagggcatcgccgaggtgaaggaggagatcgtggagaacggcgtgaagaagctggtgcacagcgtgttcgacaccgccgactacaccttccccctgcagggcaacagcttcttcgtgatgaccaacttcctgaagaccgagggccaggagcagagactgtgccccgagtaccccaccagaagaaccctgtgcagcagcgacagaggctgcaagaagggctggatggacccccagagcaagggcatccagaccggcagatgcgtggtgtacgagggcaaccagaagacctgcgaggtgagcgcctggtgccccatcgaggccgtggaggaggcccccagacccgccctgctgaacagcgccgagaacttcaccgtgctgatcaagaacaacatcgacttccccggccacaactacaccaccagaaacatcctgcccggcctgaacatcacctgcaccttccacaagacccagaacccccagtgccccatcttcagactgggcgacatcttcagagagaccggcgacaacttcagcgacgtggccatccagggcggcatcatgggcatcgagatctactgggactgcaacctggacagatggttccaccactgcagacccaagtacagcttcagaagactggacgacaagaccaccaacgtgagcctgtaccccggctacaacttcagatacgccaagtactacaaggagaacaacgtggagaagagaaccctgatcaaggtgttcggcatcagattcgacatcctggtgttcggcaccggcggcaagttcgacatcatccagctggtggtgtacatcggcagcaccctgagctacttcggcctggccgccgtgttcatcgacttcctgatcgacacctacagcagcaactgctgcagaagccacatctacccctggtgcaagtgctgccagccctgcgtggtgaacgagtactactacagaaagaagtgcgagagcatcgtggagcccaagcccaccctgaagtacgtgagcttcgtggacgagagccacatcagaatggtgaaccagcagctgctgggcagaagcctgcaggacgtgaagggccaggaggtgcccagacccgccatggacttcaccgacctgagcagactgcccctggccctgcacgacaccccccccatccccggccagcccgaggagatccagctgctgagaaaggaggccacccccagaagcagagacagccccgtgtggtgccagtgcggcagctgcctgcccagccagctgcccgagagccacagatgcctggaggagctgtgctgcagaaagaagcccggcgcctgcatcaccaccagcgagctgttcagaaagctggtgctgagcagacacgtgctgcagttcctgctgctgtaccaggagcccctgctggccctggacgtggacagcaccaacagcagactgagacactgcgcctacagatgctacgccacctggagattcggcagccaggacatggccgacttcgccaacctgcccagctgctgcagatggagaatcagaaaggagttccccaagagcgagggccagtacagcggcttcaagagcccctactag

SEQ ID NO: 95880 - DNA, 1122 bp, Artificial Sequence
  Description of Artificial Sequence: Synthetic coding sequence
atgaccgaggtgctgtggcccgccgtgcccaacggcaccgacgccgccttcctggccggccccggcagcagctggggcaacagcaccgtggccagcaccgccgccgtgagcagcagcttcaagtgcgccctgaccaagaccggcttccagttctactacctgcccgccgtgtacatcctggtgttcatcatcggcttcctgggcaacagcgtggccatctggatgttcgtgttccacatgaagccctggagcggcatcagcgtgtacatgttcaacctggccctggccgacttcctgtacgtgctgaccctgcccgccctgatcttctactacttcaacaagaccgactggatcttcggcgacgccatgtgcaagctgcagagattcatcttccacgtgaacctgtacggcagcatcctgttcctgacctgcatcagcgcccacagatacagcggcgtggtgtaccccctgaagagcctgggcagactgaagaagaagaacgccatctgcatcagcgtgctggtgtggctgatcgtggtggtggccatcagccccatcctgttctacagcggcaccggcgtgagaaagaacaagaccatcacctgctacgacaccaccagcgacgagtacctgagaagctacttcatctacagcatgtgcaccaccgtggccatgttctgcgtgcccctggtgctgatcctgggctgctacggcctgatcgtgagagccctgatctacaaggacctggacaacagccccctgagaagaaagagcatctacctggtgatcatcgtgctgaccgtgttcgccgtgagctacatccccttccacgtgatgaagaccatgaacctgagagccagactggacttccagacccccgccatgtgcgccttcaacgacagagtgtacgccacctaccaggtgaccagaggcctggccagcctgaacagctgcgtggaccccatcctgtacttcctggccggcgacaccttcagaagaagactgagcagagccaccagaaaggccagcagaagaagcgaggccaacctgcagagcaagagcgaggacatgaccctgaacatcctgcccgagttcaagcagaacggcgacaccagcctgtag

SEQ ID NO: 95881 - DNA, 1125 bp, Artificial Sequence
  Description of Artificial Sequence: Synthetic coding sequence
atggccgccaacgtgagcggcgccaagagctgccccgccaacttcctggccgccgccgacgacaagctgagcggcttccagggcgacttcctgtggcccatcctggtggtggagttcctggtggccgtggccagcaacggcctggccctgtacagattcagcatcagaaagcagagaccctggcaccccgccgtggtgttcagcgtgcagctggccgtgagcgacctgctgtgcgccctgaccctgccccccctggccgcctacctgtacccccccaagcactggagatacggcgaggccgcctgcagactggagagattcctgttcacctgcaacctgctgggcagcgtgatcttcatcacctgcatcagcctgaacagatacctgggcatcgtgcaccccttcttcgccagaagccacctgagacccaagcacgcctgggccgtgagcgccgccggctgggtgctggccgccctgctggccatgcccaccctgagcttcagccacctgaagagaccccagcagggcgccggcaactgcagcgtggccagacccgaggcctgcatcaagtgcctgggcaccgccgaccacggcctggccgcctacagagcctacagcctggtgctggccggcctgggctgcggcctgcccctgctgctgaccctggccgcctacggcgccctgggcagagccgtgctgagaagccccggcatgaccgtggccgagaagctgagagtggccgccctggtggccagcggcgtggccctgtacgccagcagctacgtgccctaccacatcatgagagtgctgaacgtggacgccagaagaagatggagcaccagatgccccagcttcgccgacatcgcccaggccaccgccgccctggagctgggcccctacgtgggctaccaggtgatgagaggcctgatgcccctggccttctgcgtgcaccccctgctgtacatggccgccgtgcccagcctgggctgctgctgcagacactgccccggctacagagacagctggaaccccgaggacgccaagagcaccggccaggccctgcccctgaacgccaccgccgcccccaagcccagcgagccccagagcagagagctgagccagtag

SEQ ID NO: 95882 - DNA, 1029 bp, Artificial Sequence
  Description of Artificial Sequence: Synthetic coding sequence
atgcaggccgtggacaacctgaccagcgcccccggcaacaccagcctgtgcaccagagactacaagatcacccaggtgctgttccccctgctgtacaccgtgctgttcttcgtgggcctgatcaccaacggcctggccatgagaatcttcttccagatcagaagcaagagcaacttcatcatcttcctgaagaacaccgtgatcagcgacctgctgatgatcctgaccttccccttcaagatcctgagcgacgccaagctgggcaccggccccctgagaaccttcgtgtgccaggtgaccagcgtgatcttctacttcaccatgtacatcagcatcagcttcctgggcctgatcaccatcgacagataccagaagaccaccagacccttcaagaccagcaaccccaagaacctgctgggcgccaagatcctgagcgtggtgatctgggccttcatgttcctgctgagcctgcccaacatgatcctgaccaacagacagcccagagacaagaacgtgaagaagtgcagcttcctgaagagcgagttcggcctggtgtggcacgagatcgtgaactacatctgccaggtgatcttctggatcaacttcctgatcgtgatcgtgtgctacaccctgatcaccaaggagctgtacagaagctacgtgagaaccagaggcgtgggcaaggtgcccagaaagaaggtgaacgtgaaggtgttcatcatcatcgccgtgttcttcatctgcttcgtgcccttccacttcgccagaatcccctacaccctgagccagaccagagacgtgttcgactgcaccgccgagaacaccctgttctacgtgaaggagagcaccctgtggctgaccagcctgaacgcctgcctggaccccttcatctacttcttcctgtgcaagagcttcagaaacagcctgatcagcatgctgaagtgccccaacagcgccaccagcctgagccaggacaacagaaagaaggagcaggacggcggcgaccccaacgaggagacccccatgtag

SEQ ID NO: 95883 - DNA, 738 bp, Artificial Sequence
  Description of Artificial Sequence: Synthetic coding sequence
atgcaggccgtggacaacctgaccagcgcccccggcaacaccagcctgtgcaccagagactacaagatcacccaggtgctgttccccctgctgtacaccgtgctgttcttcgtgggcctgatcaccaacggcctggccatgagaatcttcttccagatcagaagcaagagcaacttcatcatcttcctgaagaacaccgtgatcagcgacctgctgatgatcctgaccttccccttcaagatcctgagcgacgccaagctgggcaccggccccctgagaaccttcgtgtgccaggtgatcttctggatcaacttcctgatcgtgatcgtgtgctacaccctgatcaccaaggagctgtacagaagctacgtgagaaccagaggcgtgggcaaggtgcccagaaagaaggtgaacgtgaaggtgttcatcatcatcgccgtgttcttcatctgcttcgtgcccttccacttcgccagaatcccctacaccctgagccagaccagagacgtgttcgactgcaccgccgagaacaccctgttctacgtgaaggagagcaccctgtggctgaccagcctgaacgcctgcctggaccccttcatctacttcttcctgtgcaagagcttcagaaacagcctgatcagcatgctgaagtgccccaacagcgccaccagcctgagccaggacaacagaaagaaggagcaggacggcggcgaccccaacgaggagacccccatgtag

SEQ ID NO: 95884 - DNA, 1134 bp, Artificial Sequence
  Description of Artificial Sequence: Synthetic coding sequence
atggccgccgacctgggcccctggaacgacaccatcaacggcacctgggacggcgacgagctgggctacagatgcagattcaacgaggacttcaagtacgtgctgctgcccgtgagctacggcgtggtgtgcgtgcccggcctgtgcctgaacgccgtggccctgtacatcttcctgtgcagactgaagacctggaacgccagcaccacctacatgttccacctggccgtgagcgacgccctgtacgccgccagcctgcccctgctggtgtactactacgccagaggcgaccactggcccttcagcaccgtgctgtgcaagctggtgagattcctgttctacaccaacctgtactgcagcatcctgttcctgacctgcatcagcgtgcacagatgcctgggcgtgctgagacccctgagaagcctgagatggggcagagccagatacgccagaagagtggccggcgccgtgtgggtgctggtgctggcctgccaggcccccgtgctgtacttcgtgaccaccagcgccagaggcggcagagtgacctgccacgacaccagcgcccccgagctgttcagcagattcgtggcctacagcagcgtgatgctgggcctgctgttcgccgtgcccttcgccgtgatcctggtgtgctacgtgctgatggccagaagactgctgaagcccgcctacggcaccagcggcggcctgcccagagccaagagaaagagcgtgagaaccatcgccgtggtgctggccgtgttcgccctgtgcttcctgcccttccacgtgaccagaaccctgtactacagcttcagaagcctggacctgagctgccacaccctgaacgccatcaacatggcctacaaggtgaccagacccctggccagcgccaacagctgcctggaccccgtgctgtacttcctggccggccagagactggtgagattcgccagagacgccaagccccccaccggccccagccccgccacccccgccagaagaagactgggcctgagaagaagcgacagaaccgacatgcagagaatcgaggacgtgctgggcagcagcgaggacagcagaagaaccgagagcacccccgccggcagcgagaacaccaaggacatcagactgtag

SEQ ID NO: 95885 - DNA, 1134 bp, Artificial Sequence; identical to SEQ ID NO: 95884
  Description of Artificial Sequence: Synthetic coding sequence

SEQ ID NO: 95886 - DNA, 1134 bp, Artificial Sequence; identical to SEQ ID NO: 95884
  Description of Artificial Sequence: Synthetic coding sequence

SEQ ID NO: 95887 - DNA, 1080 bp, Artificial Sequence
  Description of Artificial Sequence: Synthetic coding sequence
atgcaggtgcccaacagcaccggccccgacaacgccaccctgcagatgctgagaaaccccgccatcgccgtggccctgcccgtggtgtacagcctggtggccgccgtgagcatccccggcaacctgttcagcctgtgggtgctgtgcagaagaatgggccccagaagccccagcgtgatcttcatgatcaacctgagcgtgaccgacctgatgctggccagcgtgctgcccttccagatctactaccactgcaacagacaccactgggtgttcggcgtgctgctgtgcaacgtggtgaccgtggccttctacgccaacatgtacagcagcatcctgaccatgacctgcatcagcgtggagagattcctgggcgtgctgtaccccctgagcagcaagagatggagaagaagaagatacgccgtggccgcctgcgccggcacctggctgctgctgctgaccgccctgagccccctggccagaaccgacctgacctaccccgtgcacgccctgggcatcatcacctgcttcgacgtgctgaagtggaccatgctgcccagcgtggccatgtgggccgtgttcctgttcaccatcttcatcctgctgttcctgatccccttcgtgatcaccgtggcctgctacaccgccaccatcctgaagctgctgagaaccgaggaggcccacggcagagagcagagaagaagagccgtgggcctggccgccgtggtgctgctggccttcgtgacctgcttcgcccccaacaacttcgtgctgctggcccacatcgtgagcagactgttctacggcaagagctactaccacgtgtacaagctgaccctgtgcctgagctgcctgaacaactgcctggaccccttcgtgtactacttcgccagcagagagttccagctgagactgagagagtacctgggctgcagaagagtgcccagagacaccctggacaccagaagagagagcctgttcagcgccagaaccaccagcgtgagaagcgaggccggcgcccaccccgagggcatggagggcgccaccagacccggcctgcagagacaggagagcgtgttctag

SEQ ID NO: 95888 - DNA, 189 bp, Artificial Sequence
  Description of Artificial Sequence: Synthetic coding sequence
atgagcgagagacagggcgccggcgccaccaacggcaaggacaagaccagcggcgagaacgacggccagaagaaggtgcaggaggagttcgacatcgacatggacgcccccgagaccgagagagccgccgtggccatccagagccagttcagaaagttccagaagaagaaggccggcagccagagctag

SEQ ID NO: 95889 - DNA, 1914 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgctgtacttcatgcaggtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaaagctgagaaagaccgtgaacggcgacggcagcagagagaacggcaacaacagcagcgacaaggtgagaggcatcgagaccctggagagcgtgcccatcatcggcggcttctgggagaccatcttcggcaacagaatcaagagagtgaagctgatcagcaacaagggcaccgagaccgacaacgaccccagctgcgtgcaccccatcatcaagagaagacagtgcagacccgagatcagaatgtggcagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcagagattcctgttcgccaagctgttcagccacatcaccagcgccagaaaggccagaaagtacgagatcccccacttcagactgaagaaggtggagaacatcaagatctggctgagcctgagaagctacctgaagagaagaggcccccagagaagcgtggacgtggtggtgagcagcgtgttcctgctgaccctgagcatcgccttcatctgctgcgcccaggtgaaggtgagccacctgctgtag

SEQ ID NO: 95890 - DNA, 2130 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagagtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaaagctgagaaagaccgtgaacggcgacggcagcagagagaacggcaacaacagcagcgacaaggtgagaggcatcgagaccctggagagcgtgcccatcatcggcggcttctgggagaccatcttcggcaacagaatcaagagagtgaagctgatcagcaacaagggcaccgagaccgacaacgaccccagctgcgtgcaccccatcatcaagagaagacagtgcagacccgagatcagaatgtggcagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcagagattcctgttcgccaagctgttcagccacatcaccagcgccagaaaggccagaaagtacgagatcccccacttcagactgaagaaggtggagaacatcaagatctggctgagcctgagaagctacctgaagagaagaggcccccagagaagcgtggacgtggtggtgagcagcgtgttcctgctgaccctgagcatcgccttcatctgctgcgcccaggtgctgcagggccacaagaccttcctgaacgacgcctacaactgggagttcctgatctgggagaccgccctgctgctgttcctgctgagactggccagcctgggcagcgagaccaacaagaagtacagcaacgtgagcatcctgctgaccgagcagatcaacctgtacctgaagatggagaagaagcccaacaagaaggagcagctgaccctggtgaacaacgtgctgaagctgagcaccaagctgctgaaggagctggacacccccttcagactgtacggcctgaccatgaaccccctgatctacaacatcaccagagtggtgatcctgagcgccgtgagcggcgtgatcagcgacctgctgggcttcaacatcagactgtggaagatcaagagctag

SEQ ID NO: 95891 - DNA, 2154 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgctgtacttcatgcaggtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaatcaagagagtgaagctgatcagcaacaagggcaccgagaccgacaacgaccccagctgcgtgcaccccatcatcaagagaagacagtgcagacccgagatcagaatgtggcagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcagagattcctgttcgccaagctgttcagccacatcaccagcgccagaaaggccagaaagtacgagatcccccacttcagactgaagaaggtggagaacatcaagatctggctgagcctgagaagctacctgaagagaagaggcccccagagaagcgtggacgtggtggtgagcagcgtgttcctgctgaccctgagcatcgccttcatctgctgcgcccaggtgctgcagggccacaagaccttcctgaacgacgcctacaactgggagttcctgatctgggagaccgccctgctgctgttcctgctgagactggccagcctgggcagcgagaccaacaagaagtacagcaacgtgagcatcctgctgaccgagcagatcaacctgtacctgaagatggagaagaagcccaacaagaaggagcagctgaccctggtgaacaacgtgctgaagctgagcaccaagctgctgaaggagctggacacccccttcagactgtacggcctgaccatgaaccccctgatctacaacatcaccagagtggtgatcctgagcgccgtgagcggcgtgatcagcgacctgctgggcttcaacatcagaatctggaagcacagcagctag

SEQ ID NO: 95892 - DNA, 2154 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgctgtacttcatgcaggtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaatcaagagagtgaagctgatcagcaacaagggcaccgagaccgacaacgaccccagctgcgtgcaccccatcatcaagagaagacagtgcagacccgagatcagaatgtggcagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcagagattcctgttcgccaagctgttcagccacatcaccagcgccagaaaggccagaaagtacgagatcccccacttcagactgaagaaggtggagaacatcaagatctggctgagcctgagaagctacctgaagagaagaggcccccagagaagcgtggacgtggtggtgagcagcgtgttcctgctgaccctgagcatcgccttcatctgctgcgcccaggtgctgcagggccacaagaccttcctgaacgacgcctacaactgggagttcctgatctgggagaccgccctgctgctgttcctgctgagactggccagcctgggcagcgagaccaacaagaagtacagcaacgtgagcatcctgctgaccgagcagatcaacctgtacctgaagatggagaagaagcccaacaagaaggagcagctgaccctggtgaacaacgtgctgaagctgagcaccaagctgctgaaggagctggacacccccttcagactgtacggcctgaccatgaaccccctgatctacaacatcaccagagtggtgatcctgagcgccgtgagcggcgtgatcagcgacctgctgggcttcaacatcagactgtggaagatcaagagctag

SEQ ID NO: 95893 - DNA, 2130 bp, Artificial Sequence; identical to SEQ ID NO: 95890
  Description of Artificial Sequence: Synthetic coding sequence

SEQ ID NO: 95894 - DNA, 2289 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgctgtacttcatgcaggtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaaagctgagaaagaccgtgaacggcgacggcagcagagagaacggcaacaacagcagcgacaaggtgagaggcatcgagaccctggagagcgtgcccatcatcggcggcttctgggagaccatcttcggcaacagaatcaagagagtgaagctgatcagcaacaagggcaccgagaccgacaacgaccccagctgcgtgcaccccatcatcaagagaagacagtgcagacccgagatcagaatgtggcagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcagagattcctgttcgccaagctgttcagccacatcaccagcgccagaaaggccagaaagtacgagatcccccacttcagactgaagaaggtggagaacatcaagatctggctgagcctgagaagctacctgaagagaagaggcccccagagaagcgtggacgtggtggtgagcagcgtgttcctgctgaccctgagcatcgccttcatctgctgcgcccaggtgctgcagggccacaagaccttcctgaacgacgcctacaactgggagttcctgatctgggagaccgccctgctgctgttcctgctgagactggccagcctgggcagcgagaccaacaagaagtacagcaacgtgagcatcctgctgaccgagcagatcaacctgtacctgaagatggagaagaagcccaacaagaaggagcagctgaccctggtgaacaacgtgctgaagctgagcaccaagctgctgaaggagctggacacccccttcagactgtacggcctgaccatgaaccccctgatctacaacatcaccagagtggtgatcctgagcgccgtgagcggcgtgatcagcgacctgctgggcttcaacatcagactgtggaagatcaagagctag

SEQ ID NO: 95895 - DNA, 2289 bp, Artificial Sequence; identical to SEQ ID NO: 95894
  Description of Artificial Sequence: Synthetic coding sequence

SEQ ID NO: 95896 - DNA, 996 bp, Artificial Sequence
  Description of Artificial Sequence: Synthetic coding sequence
tgacagaccagagagaaggccaagttcagcgacggcgagaagtgcagaagagaggccttcagaagactgggcaacggcgtgagcgacgacctgagcagcgaggaggacggcgaggccagaacccagatgatcctgctgagaagaagcgtggagggcgccagcagcgacaacggctgcgaggtgaagaacagaaagagcatcctgagcagacacctgaacagccaggtgaagaagaccaccaccagatggtgccacatcgtgagagacagcgacagcctggccgagagcgagttcgagagcgccgccttcagccagggcagcagaagcggcgtgagcggcggcagcagaagcctgaacatgagcagaagagacagcgagagcaccagacacgacagcgagaccgaggacatgctgtgggacgacctgctgcacggccccgagtgcagaagcagcgtgaccagcgacagcgagggcgcccacgtgaacaccctgcacagcggcaccaagagagaccccaaggaggacgtgttccagcagaaccacctgttctggctgcagaacagcagccccagcagcgacagagtgagcgccatcatctgggagggcaacgagtgcaagaagatggacatgagcgtgctggagatcagcggcatcatcatgagcagagtgaacgcctaccagcagggcgtgggctaccagatgctgggcaacgtggtgaccatcggcctggccttcttccccttcctgcacagactgttcagagagaagagcctggaccagctgaagagcatcagcgccgaggagatcctgaccctgttctgcggcgccccccccgtgacccccatcatcgtgctgagcatcatcaacttcttcgagagactgtgcctgacctggatgttcttcttcatgatgtgcgtggccgagagaacctacaagcaggtgagcggcgagatcagaaagatcttctacctgttcctgtacatgatcttccactag

SEQ ID NO: 95897 - DNA, 318 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgtag

SEQ ID NO: 95898 - DNA, 702 bp, Artificial Sequence
  Description of Artificial Sequence: Synthetic coding sequence
atggccagcaacgagagagacgccatcagctggtaccagaagaagatcggcgcctacgaccagcagatctgggagaagagcatcgagcagacccagatcaagggcctgaagaacaagcccaagaagatgggccacatcaagcccgacctgatcgacgtggacctgatcagaggcagcaccttcgccaaggccaagcccgagatcccctggaccagcctgaccagaaagggcctggtgagagtggtgttcttccccctgttcagcaactggtggatccaggtgaccagcctgagaatcttcgtgtggctgctgctgctgtacttcatgcaggtgatcgccatcgtgctgtacctgatgatgcccatcgtgaacatcagcgaggtgctgggccccctgtgcctgatgctgctgatgggcaccgtgcactgccagatcgtgagcacccagatcaccagacccagcggcaacaacggcaacagaagaagaagaaagctgagaaagaccgtgaacggcgacggcagcagagagaacggcaacaacagcagcgacaaggtgagaggcatcgagaccctggagagcgtgcccatcatcggcggcttctgggagaccatcttcggcaacagaagactgctgggcgtgtgggtgatgggctgcctgatgacctgccaggtgaagaagatggtgaagcacggccacagatag

SEQ ID NO: 95899 - DNA, 2760 bp, Artificial Sequence
  Description of Artificial Sequence: Synthetic coding sequence
atgaagttcgcctacagattcagcaacctgctgggcaccgtgtacagaagaggcaacctgaacttcacctgcgacggcaacagcgtgatcagccccgtgggcaacagagtgaccgtgttcgacctgaagaacaacaagagcgacaccctgcccctggccaccagatacaacgtgaagtgcgtgggcctgagccccgacggcagactggccatcatcgtggacgagggcggcgacgccctgctggtgagcctggtgtgcagaagcgtgctgcaccacttccacttcaagggcagcgtgcacagcgtgagcttcagccccgacggcagaaagttcgtggtgaccaagggcaacatcgcccagatgtaccacgcccccggcaagaagagagagttcaacgccttcgtgctggacaagacctacttcggcccctacgacgagaccacctgcatcgactggaccgacgacagcagatgcttcgtggtgggcagcaaggacatgagcacctgggtgttcggcgccgagagatgggacaacctgatctactacgccctgggcggccacaaggacgccatcgtggcctgcttcttcgagagcaacagcctggacctgtacagcctgagccaggacggcgtgctgtgcatgtggcagtgcgacaccccccccgagggcctgagactgaagccccccgccggctggaaggccgacctgctgcagagagaggaggaggaggaggaggaggaggaccaggagggcgacagagagaccaccatcagaggcaaggccacccccgccgaggaggagaagaccggcaaggtgaagtacagcagactggccaagtacttcttcaacaaggagggcgacttcaacaacctgaccgccgccgccttccacaagaagagccacctgctggtgaccggcttcgccagcggcatcttccacctgcacgagctgcccgagttcaacctgatccacagcctgagcatcagcgaccagagcatcgccagcgtggccatcaacagcagcggcgactggatcgccttcggctgcagcggcctgggccagctgctggtgtgggagtggcagagcgagagctacgtgctgaagcagcagggccacttcaacagcatggtggccctggcctacagccccgacggccagtacatcgtgaccggcggcgacgacggcaaggtgaaggtgtggaacaccctgagcggcttctgcttcgtgaccttcaccgagcacagcagcggcgtgaccggcgtgaccttcaccgccaccggctacgtggtggtgaccagcagcatggacggcaccgtgagagccttcgacctgcacagatacagaaacttcagaaccttcaccagccccagacccacccagttcagctgcgtggccgtggacgccagcggcgagatcgtgagcgccggcgcccaggacagcttcgagatcttcgtgtggagcatgcagaccggcagactgctggacgtgctgagcggccacgagggccccatcagcggcctgtgcttcaaccccatgaagagcgtgctggccagcgccagctgggacaagaccgtgagactgtgggacatgttcgacagctggagaaccaaggagaccctggccctgaccagcgacgccctggccgtgaccttcagacccgacggcgccgagctggccgtggccaccctgaacagccagatcaccttctgggaccccgagaacgccgtgcagaccggcagcatcgagggcagacacgacctgaagaccggcagaaaggagctggacaagatcaccgccaagcacgccgccaagggcaaggccttcaccgccctgtgctacagcgccgacggccacagcatcctggccggcggcatgagcaagttcgtgtgcatctaccacgtgagagagcagatcctgatgaagagattcgagatcagctgcaacctgagcctggacgccatggaggagttcctgaacagaagaaagatgaccgagttcggcaacctggccctgatcgaccaggacgccggccaggaggacggcgtggccatccccctgcccggcgtgagaaagggcgacatgagcagcagacacttcaagcccgagatcagagtgaccagcctgagattcagccccaccggcagatgctgggccgccaccaccaccgagggcctgctgatctacagcctggacaccagagtgctgttcgaccccttcgagctggacaccagcgtgacccccggcagagtgagagaggccctgagacagcaggacttcaccagagccatcctgatggccctgagactgaacgagagcaagctggtgcaggaggccctggaggccgtgcccagaggcgagatcgaggtggtgaccagcagcctgcccgagctgtacgtggagaaggtgctggagttcctggccagcagcttcgaggtgagcagacacctggagttctacctgctgtggacccacaagctgctgatgctgcacggccagaagctgaagagcagagccggcaccctgctgcccgtgatccagttcctgcagaagagcatccagagacacctggacgacctgagcaagctgtgcagctggaaccactacaacatgcagtacgccctggccgtgagcaagcagagaggcaccaagagaagcctggaccccctgggcagcgaggaggaggccgaggccagcgaggacgacagcctgcacctgctgggcggcggcggcagagacagcgaggaggagatgctggcctag

SEQ ID NO: 95900 - DNA, 1686 bp, Artificial Sequence
  Description of Artificial Sequence: Synthetic coding sequence
atggccttcatggagaagccccccgccggcaaggtgctgctggacgacaccgtgcccctgaccgccgccatcgaggccagccagagcctgcagagccacaccatcgtgagaagatacagcgacttcgacctgctgaacaacagcctgcagatcgccggcctgagcctgcccctgccccccaagaagctgatcggcaacatggacagagagttcatcgccgagagacagaagggcctgcagaactacctgaacgtgatcaccaccaaccacatcctgagcaactgcgagctggtgaagaagttcctggaccccaacaactacagcgccaactacaccgagatcgccctgcagcaggtgagcatgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagagaaagatcctggccagaaagaagagcaagagaagcgccctggagaacagcgaggagcacagcgccaagtacagcaacagcaacaacagcgccggcagcggcgccagcagccccctgaccagccccagcagccccaccccccccagcaccagcggcatcagcgccctgccccccccccccccccccccccccccccccgccgcccccctgccccccgccagcaccgaggcccccgcccagctgagcagccaggccgtgaacggcatgagcagaggcgccctgctgagcagcatccagaacttccagaagggcaccctgagaaaggccaagacctgcgaccacagcgcccccaagatcggctag

SEQ ID NO: 95901 - DNA, 1737 bp, Artificial Sequence
  Description of Artificial Sequence: Synthetic coding sequence
atggccttcatggagaagccccccgccggcaaggtgctgctggacgacaccgtgcccctgaccgccgccatcgaggccagccagagcctgcagagccacaccgagtacatcatcagagtgcagagaggcatcagcgtggagaacagctggcagatcgtgagaagatacagcgacttcgacctgctgaacaacagcctgcagatcgccggcctgagcctgcccctgccccccaagaagctgatcggcaacatggacagagagttcatcgccgagagacagaagggcctgcagaactacctgaacgtgatcaccaccaaccacatcctgagcaactgcgagctggtgaagaagttcctggaccccaacaactacagcgccaactacaccgagatcgccctgcagcaggtgagcatgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagagaaagatcctggccagaaagaagagcaagagaagcgccctggagaacagcgaggagcacagcgccaagtacagcaacagcaacaacagcgccggcagcggcgccagcagccccctgaccagccccagcagccccaccccccccagcaccagcggcatcagcgccctgccccccccccccccccccccccccccccccgccgcccccctgccccccgccagcaccgaggcccccgcccagctgagcagccaggccgtgaacggcatgagcagaggcgccctgctgagcagcatccagaacttccagaagggcaccctgagaaaggccaagacctgcgaccacagcgcccccaagatcggctag

SEQ ID NO: 95902 - DNA, 1638 bp, Artificial Sequence
  Description of Artificial Sequence: Synthetic coding sequence
atggccttcatggagaagccccccgccggcaaggtgctgctggacgacaccgtgcccctgaccgccgccatcgaggccagccagagcctgcagagccacaccatcgccggcctgagcctgcccctgccccccaagaagctgatcggcaacatggacagagagttcatcgccgagagacagaagggcctgcagaactacctgaacgtgatcaccaccaaccacatcctgagcaactgcgagctggtgaagaagttcctggaccccaacaactacagcgccaactacaccgagatcgccctgcagcaggtgagcatgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagagaaagatcctggccagaaagaagagcaagagaagcgccctggagaacagcgaggagcacagcgccaagtacagcaacagcaacaacagcgccggcagcggcgccagcagccccctgaccagccccagcagccccaccccccccagcaccagcggcatcagcgccctgccccccccccccccccccccccccccccccgccgcccccctgccccccgccagcaccgaggcccccgcccagctgagcagccaggccgtgaacggcatgagcagaggcgccctgctgagcagcatccagaacttccagaagggcaccctgagaaaggccaagacctgcgaccacagcgcccccaagatcggctag

SEQ ID NO: 95903 - DNA, 1548 bp, Artificial Sequence
  Description of Artificial Sequence: Synthetic coding sequence
atggccttcatggagaagccccccgccggcaaggtgctgctggacgacaccgtgcccctgaccgccgccatcgaggccagccagagcctgcagagccacaccgagtacatcatcagagtgcagagaggcatcagcgtggagaacagctggcagatcgtgagaagatacagcgacttcgacctgctgaacaacagcctgcagatcgccggcctgagcctgcccctgccccccaagaagctgatcggcaacatggacagagagttcatcgccgagagacagaagggcctgcagaactacctgaacgtgatcaccaccaaccacatcctgagcaactgcgagctggtgaagaagttcctggaccccaacaactacagcgccaactacaccgagatcgccctgcagcaggtgagcatgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagagaaagatcctggccagaaagaagagcaagagaagcgccctggagaacagcgaggagcacagcgccaagtacagcaacagcaacaacagcgccggcagcggcgccagcagccccctgaccagccccagcagccccaccccccccagcaccagcgtggagcacgcccccttctag

SEQ ID NO: 95904 - DNA, 1326 bp, Artificial Sequence
  Description of Artificial Sequence: Synthetic coding sequence
atgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagagaaagatcctggccagaaagaagagcaagagaagcgccctggagaacagcgaggagcacagcgccaagtacagcaacagcaacaacagcgccggcagcggcgccagcagccccctgaccagccccagcagccccaccccccccagcaccagcggcatcagcgccctgccccccccccccccccccccccccccccccgccgcccccctgccccccgccagcaccgaggcccccgcccagctgagcagccaggccgtgaacggcatgagcagaggcgccctgctgagcagcatccagaacttccagaagggcaccctgagaaaggccaagacctgcgaccacagcgcccccaagatcggctag

SEQ ID NO: 95905 - DNA, 1005 bp, Artificial Sequence
  Description of Artificial Sequence: Synthetic coding sequence
atgttcttcagaagcgagcccaagtgggaggtggtggagcccctgaaggacatcggctggagaatcagaaagaagtacttcctgatgaagatcaagaaccagcccaaggagagactggtgctgagctgggccgacctgggccccgacaagtacctgagcgacaaggacttccagtgcctgatcaagctgctgcccagctgcctgcacccctacatctacagagtgaccttcgccaccgccaacgagagcagcgccctgctgatcagaatgttcaacgagaagggcaccctgaaggacctgatctacaaggccaagcccaaggaccccttcctgaagaagtactgcaaccccaagaagatccagggcctggagctgcagcagatcaagacctacggcagacagatcctggaggtgctgaagttcctgcacgacaagggcttcccctacggccacctgcacgccagcaacgtgatgctggacggcgacacctgcagactgctggacctggagaacagcctgctgggcctgcccagcttctacagaagctacttcagccagttcagaaagatcaacaccctggagagcgtggacgtgcactgcttcggccacctgctgtacgagatgacctacggcagaccccccgacagcgtgcccgtggacagcttcccccccgcccccagcatggccgtggtggccgtgctggagagcaccctgagctgcgaggcctgcaagaacggcatgcccaccatcagcagactgctgcagatgcccctgttcagcgacgtgctgctgaccaccagcgagaagccccagttcaagatccccaccaagctgaaggaggccctgagaatcgccaaggagtgcatcgagaagagactgatcgaggagcagaagcagatccaccagcacagaagactgaccagagcccagagccaccacggcagcgaggaggagagaaagaagaaggacttcagcagcaaggaggtgaagaccatctgcagctag

SEQ ID NO: 95906 - DNA, 1110 bp, Artificial Sequence
  Description of Artificial Sequence: Synthetic coding sequence
atgaagagccccgagaagaagagaagaaagagcaacacccagggccccgcctacagccacctgaccgagttcgcccccccccccacccccatggtggaccacctggtggccagcaaccccttcgaggacgacttcggcgcccccaaggtgggcgtggccgccccccccttcctgggcagccccgtgcccttcggcggcttcagagtgcagggcggcatggccggccaggtgccccccggctacagcaccggcggcggcggcggcccccagcccctgagaagacagcccccccccttcccccccaaccccatgggccccgccttcaacatgcccccccagggccccggctaccccccccccggcaacatgaacttccccagccagcccttcaaccagcccctgggccagaacttcagcccccccagcggccagatgatgcccggccccgtgggcggcttcggccccatgatcagccccaccatgggccagccccccagagccgagctgggcccccccagcctgagccagagattcgcccagcccggcgcccccttcggccccagccccctgcagagacccggccagggcctgcccagcctgccccccaacaccagccccttccccggccccgaccccggcttccccggccccggcggcgaggacggcggcaagcccctgaacccccccgccagcaccgccttcccccaggagccccacagcggcagccccgccgccgccgtgaacggcaaccagcccagcttcccccccaacagcagcggcagaggcggcggcacccccgacgccaacagcctggccccccccggcaaggccggcggcggcagcggcccccagcccccccccggcctggtgtacccctgcggcgcctgcagaagcgaggtgaacgacgaccaggacgccatcctgtgcgaggccagctgccagaagtggttccacagagagtgcaccggcatgaccgagagcgcctacggcctgctgaccaccgaggccagcgccgtgtgggcctgcgacctgtgcctgaagaccaaggagatccagagcgtgtacatcagagagggcatgggccagctggtggccgccaacgacggctag

SEQ ID NO: 95907 - DNA, 1221 bp, Artificial Sequence
  Description of Artificial Sequence: Synthetic coding sequence
atggccgccagcgccccccccccccccgacaagctggagggcggcggcggccccgcccccccccccgccccccccagcaccggcagaaagcagggcaaggccggcctgcagatgaagagccccgagaagaagagaagaaagagcaacacccagggccccgcctacagccacctgaccgagttcgcccccccccccacccccatggtggaccacctggtggccagcaaccccttcgaggacgacttcggcgcccccaaggtgggcgtggccgccccccccttcctgggcagccccgtgcccttcggcggcttcagagtgcagggcggcatggccggccaggtgccccccggctacagcaccggcggcggcggcggcccccagcccctgagaagacagcccccccccttcccccccaaccccatgggccccgccttcaacatgcccccccagggccccggctaccccccccccggcaacatgaacttccccagccagcccttcaaccagcccctgggccagaacttcagcccccccagcggccagatgatgcccggccccgtgggcggcttcggccccatgatcagccccaccatgggccagccccccagagccgagctgggcccccccagcctgagccagagattcgcccagcccggcgcccccttcggccccagccccctgcagagacccggccagggcctgcccagcctgccccccaacaccagccccttccccggccccgaccccggcttccccggccccggcggcgaggacggcggcaagcccctgaacccccccgccagcaccgccttcccccaggagccccacagcggcagccccgccgccgccgtgaacggcaaccagcccagcttcccccccaacagcagcggcagaggcggcggcacccccgacgccaacagcctggccccccccggcaaggccggcggcggcagcggcccccagcccccccccggcctggtgtacccctgcggcgcctgcagaagcgaggtgaacgacgaccaggacgccatcctgtgcgaggccagctgccagaagtggttccacagagagtgcaccggcatgaccgagagcgcctacggcctgctgaccaccgaggccagcgccgtgtgggcctgcgacctgtgcctgaagaccaaggagatccagagcgtgtacatcagagagggcatgggccagctggtggccgccaacgacggctag

SEQ ID NO: 95908 - DNA, 939 bp, Artificial Sequence
  Description of Artificial Sequence: Synthetic coding sequence
atggaggaggagtgcagagtgctgagcatccagagccacgtgatcagaggctacgtgggcaacagagccgccaccttccccctgcaggtgctgggcttcgagatcgacgccgtgaacagcgtgcagttcagcaaccacaccggctacgcccactggaagggccaggtgctgaacagcgacgagctgcaggagctgtacgagggcctgagactgaacaacatgaacaagtacgactacgtgctgaccggctacaccagagacaagagcttcctggccatggtggtggacatcgtgcaggagctgaagcagcagaaccccagactggtgtacgtgtgcgaccccgtgctgggcgacaagtgggacggcgagggcagcatgtacgtgcccgaggacctgctgcccgtgtacaaggagaaggtggtgcccctggccgacatcatcacccccaaccagttcgaggccgagctgctgagcggcagaaagatccacagccaggaggaggccctgagagtgatggacatgctgcacagcatgggccccgacaccgtggtgatcaccagcagcgacctgcccagcccccagggcagcaactacctgatcgtgctgggcagccagagaagaagaaaccccgccggcagcgtggtgatggagagaatcagaatggacatcagaaaggtggacgccgtgttcgtgggcaccggcgacctgttcgccgccatgctgctggcctggacccacaagcaccccaacaacctgaaggtggcctgcgagaagaccgtgagcaccctgcaccacgtgctgcagagaaccatccagtgcgccaaggcccaggccggcgagggcgtgagacccagccccatgcagctggagctgagaatggtgcagagcaagagagacatcgaggaccccgagatcgtggtgcaggccaccgtgctgtag

SEQ ID NO: 95909 - DNA, 855 bp, Artificial Sequence
  Description of Artificial Sequence: Synthetic coding sequence
atggaggaggagtgcagagtgctgagcatccagagccacgtgatcagaggctacgtgggcaacagagccgccaccttccccctgcaggtgctgggcttcgagatcgacgccgtgaacagcgtgcagttcagcaaccacaccggctacgcccactggaagggccaggtgctgaacagcgacgagctgcaggagctgtacgagggcctgagactgaacaacatgaacaagtacgactacgtgctgaccgtgtgcgaccccgtgctgggcgacaagtgggacggcgagggcagcatgtacgtgcccgaggacctgctgcccgtgtacaaggagaaggtggtgcccctggccgacatcatcacccccaaccagttcgaggccgagctgctgagcggcagaaagatccacagccaggaggaggccctgagagtgatggacatgctgcacagcatgggccccgacaccgtggtgatcaccagcagcgacctgcccagcccccagggcagcaactacctgatcgtgctgggcagccagagaagaagaaaccccgccggcagcgtggtgatggagagaatcagaatggacatcagaaaggtggacgccgtgttcgtgggcaccggcgacctgttcgccgccatgctgctggcctggacccacaagcaccccaacaacctgaaggtggcctgcgagaagaccgtgagcaccctgcaccacgtgctgcagagaaccatccagtgcgccaaggcccaggccggcgagggcgtgagacccagccccatgcagctggagctgagaatggtgcagagcaagagagacatcgaggaccccgagatcgtggtgcaggccaccgtgctgtag

SEQ ID NO: 95910 - DNA, 2322 bp, Artificial Sequence
  Description of Artificial Sequence: Synthetic coding sequence
atgggcaagaacctgaaggaggccgtgaagatgctggaggacagccagagaagaaccgaggaggagaacggcaagaagctgatcagcggcgacatccccggccccctgcagggcagcggccaggacatggtgagcatcctgcagctggtgcagaacctgatgcacggcgacgaggacgaggagccccagagccccagaatccagaacatcggcgagcagggccacatggccctgctgggccacagcctgggcgcctacatcagcaccctggacaaggagaagctgagaaagctgaccaccagaatcctgagcgacaccaccctgtggctgtgcagaatcttcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccagctgggcctgcccttcccctgcctgtgcagagtgccctgcaacaccgtgttcggcagccagcaccagatggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccgtgctgggcaccagaggcgaggacgtggaccagctggtggcctgcatcgagagcaagctgcccgtgctgtgctgcaccctgcagctgagagaggagttcaagcaggaggtggaggccaccgccggcctgctgtacgtggacgaccccaactggagcggcatcggcgtggtgagatacgagcacgccaacgacgacaagagcagcctgaagagcgaccccgagggcgagaacatccacgccggcctgctgaagaagctgaacgagctggagagcgacctgaccttcaagatcggccccgagtacaagagcatgaagagctgcctgtacgtgggcatggccagcgacaacgtggacgccgccgagctggtggagaccatcgccgccaccgccagagagatcgaggagaacagcagactgctggagaacatgaccgaggtggtgagaaagggcatccaggaggcccaggtggagctgcagaaggccagcgaggagagactgctggaggagggcgtgctgagacagatccccgtggtgggcagcgtgctgaactggttcagccccgtgcaggccctgcagaagggcagaaccttcaacctgaccgccggcagcctggagagcaccgagcccatctacgtgtacaaggcccagggcgccggcgtgaccctgccccccacccccagcggcagcagaaccaagcagagactgcccggccagaagcccttcaagagaagcctgagaggcagcgacgccctgagcgagaccagcagcgtgagccacatcgaggacctggagaaggtggagagactgagcagcggccccgagcagatcaccctggaggccagcagcaccgagggccaccccggcgcccccagcccccagcacaccgaccagaccgaggccttccagaagggcgtgccccaccccgaggacgaccacagccaggtggagggccccgagagcctgagatag

SEQ ID NO: 95911 - DNA, 2367 bp, Artificial Sequence
  Description of Artificial Sequence: Synthetic coding sequence
atggacgccagcctggagaagatcgccgaccccaccctggccgagatgggcaagaacctgaaggaggccgtgaagatgctggaggacagccagagaagaaccgaggaggagaacggcaagaagctgatcagcggcgacatccccggccccctgcagggcagcggccaggacatggtgagcatcctgcagctggtgcagaacctgatgcacggcgacgaggacgaggagccccagagccccagaatccagaacatcggcgagcagggccacatggccctgctgggccacagcctgggcgcctacatcagcaccctggacaaggagaagctgagaaagctgaccaccagaatcctgagcgacaccaccctgtggctgtgcagaatcttcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccagctgggcctgcccttcccctgcctgtgcagagtgccctgcaacaccgtgttcggcagccagcaccagatggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccgtgctgggcaccagaggcgaggacgtggaccagctggtggcctgcatcgagagcaagctgcccgtgctgtgctgcaccctgcagctgagagaggagttcaagcaggaggtggaggccaccgccggcctgctgtacgtggacgaccccaactggagcggcatcggcgtggtgagatacgagcacgccaacgacgacaagagcagcctgaagagcgaccccgagggcgagaacatccacgccggcctgctgaagaagctgaacgagctggagagcgacctgaccttcaagatcggccccgagtacaagagcatgaagagctgcctgtacgtgggcatggccagcgacaacgtggacgccgccgagctggtggagaccatcgccgccaccgccagagagatcgaggagaacagcagactgctggagaacatgaccgaggtggtgagaaagggcatccaggaggcccaggtggagctgcagaaggccagcgaggagagactgctggaggagggcgtgctgagacagatccccgtggtgggcagcgtgctgaactggttcagccccgtgcaggccctgcagaagggcagaaccttcaacctgaccgccggcagcctggagagcaccgagcccatctacgtgtacaaggcccagggcgccggcgtgaccctgccccccacccccagcggcagcagaaccaagcagagactgcccggccagaagcccttcaagagaagcctgagaggcagcgacgccctgagcgagaccagcagcgtgagccacatcgaggacctggagaaggtggagagactgagcagcggccccgagcagatcaccctggaggccagcagcaccgagggccaccccggcgcccccagcccccagcacaccgaccagaccgaggccttccagaagggcgtgccccaccccgaggacgaccacagccaggtggagggccccgagagcctgagatag

SEQ ID NO: 95912 - DNA, 2094 bp, Artificial Sequence
  Description of Artificial Sequence: Synthetic coding sequence
atgggcaagaacctgaaggaggccgtgaagatgctggaggacagccagagaagaaccgaggaggagaacggcaagaagctgatcagcggcgacatccccggccccctgcagggcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccagctgggcctgcccttcccctgcctgtgcagagtgccctgcaacaccgtgttcggcagccagcaccagatggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccgtgctgggcaccagaggcgaggacgtggaccagctggtggcctgcatcgagagcaagctgcccgtgctgtgctgcaccctgcagctgagagaggagttcaagcaggaggtggaggccaccgccggcctgctgtacgtggacgaccccaactggagcggcatcggcgtggtgagatacgagcacgccaacgacgacaagagcagcctgaagagcgaccccgagggcgagaacatccacgccggcctgctgaagaagctgaacgagctggagagcgacctgaccttcaagatcggccccgagtacaagagcatgaagagctgcctgtacgtgggcatggccagcgacaacgtggacgccgccgagctggtggagaccatcgccgccaccgccagagagatcgaggagaacagcagactgctggagaacatgaccgaggtggtgagaaagggcatccaggaggcccaggtggagctgcagaaggccagcgaggagagactgctggaggagggcgtgctgagacagatccccgtggtgggcagcgtgctgaactggttcagccccgtgcaggccctgcagaagggcagaaccttcaacctgaccgccggcagcctggagagcaccgagcccatctacgtgtacaaggcccagggcgccggcgtgaccctgccccccacccccagcggcagcagaaccaagcagagactgcccggccagaagcccttcaagagaagcctgagaggcagcgacgccctgagcgagaccagcagcgtgagccacatcgaggacctggagaaggtggagagactgagcagcggccccgagcagatcaccctggaggccagcagcaccgagggccaccccggcgcccccagcccccagcacaccgaccagaccgaggccttccagaagggcgtgccccaccccgaggacgaccacagccaggtggagggccccgagagcctgagatag

SEQ ID NO: 95913 - DNA, 2283 bp, Artificial Sequence
  Description of Artificial Sequence: Synthetic coding sequence
atggacgccagcctggagaagatcgccgaccccaccctggccgagatgggcaagaacctgaaggaggccgtgaagatgctggaggacagccagagaaccgaggaggagaacggcaagaagctgatcagcggcgacatccccggccccctgcagggcagaatccagaacatcggcgagcagggccacatggccctgctgggccacagcctgggcgcctacatcagcaccctggacaaggagaagctgagaaagctgaccaccagaatcctgagcgacaccaccctgtggctgtgcagaatcttcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccagctgggcctgcccttcccctgcctgtgcagagtgccctgcaacaccgtgttcggcagccagcaccagatggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccgtgctgggcaccagaggcgaggacgtggaccagctggtggcctgcatcgagagcaagctgcccgtgctgtgctgcaccctgcagctgagagaggagttcaagcaggaggtggaggccaccgccggcctgctgtacgtggacgaccccaactggagcggcatcggcgtggtgagatacgagcacgccaacgacgacaagagcagcctgaagagcgaccccgagggcgagaacatccacgccggcctgctgaagaagctgaacgagctggagagcgacctgaccttcaagatcggccccgagtacaagagcatgaagagctgcctgtacgtgggcatggccagcgacaacgtggacgccgccgagctggtggagaccatcgccgccaccgccagagagatcgaggagaacagcagactgctggagaacatgaccgaggtggtgagaaagggcatccaggaggcccaggtggagctgcagaaggccagcgaggagagactgctggaggagggcgtgctgagacagatccccgtggtgggcagcgtgctgaactggttcagccccgtgcaggccctgcagaagggcagaaccttcaacctgaccgccggcagcctggagagcaccgagcccatctacgtgtacaaggcccagggcgccggcgtgaccctgccccccacccccagcggcagcagaaccaagcagagactgcccggccagaagcccttcaagagaagcctgagaggcagcgacgccctgagcgagaccagcagcgtgagccacatcgaggacctggagaaggtggagagactgagcagcggccccgagcagatcaccctggaggccagcagcaccgagggccaccccggcgcccccagcccccagcacaccgaccagaccgaggccttccagaagggcgtgccccaccccgaggacgaccacagccaggtggagggccccgagagcctgagatag

SEQ ID NO: 95914 - DNA, 1290 bp, Artificial Sequence
  Description of Artificial Sequence: Synthetic coding sequence
ctgagcagcaccctgagaagaatcgccgaccccaccctggccgagatgggcaagaacctgaaggaggccgtgaagatgctggaggacagccagagaagaaccgaggaggagaacggcaagaagctgatcagcggcgacatccccggccccctgcagggcagcggccaggacatggtgagcatcctgcagctggtgcagaacctgatgcacggcgacgaggacgaggagccccagagccccagaatccagaacatcggcgagcagggccacatggccctgctgggccacagcctgggcgcctacatcagcaccctggacaaggagaagctgagaaagctgaccaccagaatcctgagcgacaccaccctgtggctgtgcagaatcttcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccaggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatgggtgagaatggccgtgacccccctgagcttccaggtgcccgtgcaccaccaccccacctgctggtag

SEQ ID NO: 95915 - DNA, 1497 bp, Artificial Sequence
  Description of Artificial Sequence: Synthetic coding sequence
atggacgccagcctggagaagatcgccgaccccaccctggccgagatgggcaagaacctgaaggaggccgtgaagatgctggaggacagccagagaagaaccgaggaggagaacggcaagaagctgatcagcggcgacatccccggccccctgcagggcagcggccaggacatggtgagcatcctgcagctggtgcagaacctgatgcacggcgacgaggacgaggagccccagagccccagaatccagaacatcggcgagcagggccacatggccctgctgggccacagcctgggcgcctacatcagcaccctggacaaggagaagctgagaaagctgaccaccagaatcctgagcgacaccaccctgtggctgtgcagaatcttcagatacgagaacggctgcgcctacttccacgaggaggagagagagggcctggccaagatctgcagactggccatccacagcagatacgaggacttcgtggtggacggcttcaacgtgctgtacaacaagaagcccgtgatctacctgagcgccgccgccagacccggcctgggccagtacctgtgcaaccagctgggcctgcccttcccctgcctgtgcagagtgccctgcaacaccgtgttcggcagccagcaccagatggacgtggccttcctggagaagctgatcaaggacgacatcgagagaggcagactgcccctgctgctggtggccaacgccggcaccgccgccgtgggccacaccgacaagatcggcagactgaaggagctgtgcgagcagtacggcatctggctgcacgtggagggcgtgaacctggccaccctggccctgggctacgtgagcagcagcgtgctggccgccgccaagtgcgacagcatgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccggctggagccactgcggcaccaccaccagatacgactgcgtgagaagcagactgaccaccagactgcccggcagcaccggcgagcaggcccccccctag

SEQ ID NO: 95916 - DNA, 615 bp, Artificial Sequence
  Description of Artificial Sequence: Synthetic coding sequence
atgaccatgacccccggcccctggctgggcctgcccgccgtgcccgccgtgaccctgtacaagcacgacgaccccgccctgaccctggtggccggcctgaccagcaacaagcccaccgacaagctgagagccctgcccctgtggctgagcctgcagtacctgggcctggacggcttcgtggagagaatcaagcacgcctgccagctgagccagagactgcaggagagcctgaagaaggtgaactacatcaagatcctggtggaggacgagctgagcagccccgtggtggtgttcagattcttccaggagctgcccggcagcgaccccgtgttcaaggccgtgcccgtgcccaacatgacccccagcggcgtgggcagagagagacacagctgcgacgccctgaacagatggctgggcgagcagctgaagcagctggtgcccgccagcggcctgaccgtgatggacctggaggccgagggcacctgcctgagattcagccccctgatgaccgccgccggctggagccactgcggcaccaccaccagatacgactgcgtgagaagcagactgaccaccagactgcccggcagcaccggcgagcaggcccccccctag

SEQ ID NO: 95917 - DNA, 642 bp, Artificial Sequence
  Description of Artificial Sequence: Synthetic coding sequence
atggaccccctgttccagcagacccacaagcaggtgcacgagatccagagctgcatgggcagactggagaccgccgacaagcagagcgtgcacatcgtggagaacgagatccaggccagcatcgaccagatcttcagcagactggagagactggagatcctgagcagcaaggagccccccaacaagagacagaacgccagactgagagtggaccagctgaagtacgacgtgcagcacctgcagaccgccctgagaaacttccagcacagaagacacgccagagagcagcaggagagacagagagaggagctgctgagcagaaccttcaccaccaacgacagcgacaccaccatccccatggacgagagcctgcagttcaacagcagcctgcagaaggtgcacaacggcatggacgacctgatcctggacggccacaacatcctggacggcctgagaacccagagactgaccctgaagggcacccagaagaagatcctggacatcgccaacatgctgggcctgagcaacaccgtgatgagactgatcgagaagagagccttccaggacaagtacttcatgatcggcacccagggcagctgccagaccgcccacttcggcggcagaagcgccggcagcagctag

SEQ ID NO: 95918 - DNA, 657 bp, Artificial Sequence
  Description of Artificial Sequence: Synthetic coding sequence
atgacctgctggctgagaggcgtgaccgccaccttcggcagacccgccgagtggcccggctacctgagccacctgtgcggcagaagcgccgccatggacctgggccccatgagaaagagctacagaggcgacagagaggccttcgaggagacccacctgaccagcctggaccccgtgaagcagttcgccgcctggttcgaggaggccgtgcagtgccccgacatcggcgaggccaacgccatgtgcctggccacctgcaccagagacggcaagcccagcgccagaatgctgctgctgaagggcttcggcaaggacggcttcagattcttcaccaacttcgagagcagaaagggcaaggagctggacagcaaccccttcgccagcctggtgttctactgggagcccctgaacagacagtacctgagaaagaagaacgaggagctggagcagctgtaccaggaccaggaggtgcccaagcccaagagctggggcggctacgtgctgtacccccaggtgatggagttctggcagggccagaccaacagactgcacgacagaatcgtgttcagaagaggcctgcccaccggcgacagccccctgggccccatgacccacagaggcgaggaggactggctgtacgagagactggccccctag

SEQ ID NO: 95919 - DNA, 501 bp, Artificial Sequence
  Description of Artificial Sequence: Synthetic coding sequence
atgctgctgctgaagggcttcggcaaggacggcttcagattcttcaccaacttcgagagcagaaagggcaaggagctggacagcaaccccttcgccagcctggtgttctactgggagcccctgaacagacaggtgagagtggagggccccgtgaagaagctgcccgaggaggaggccgagtgctacttccacagcagacccaagagcagccagatcggcgccgtggtgagccaccagagcagcgtgatccccgacagagagtacctgagaaagaagaacgaggagctggagcagctgtaccaggaccaggaggtgcccaagcccaagagctggggcggctacgtgctgtacccccaggtgatggagttctggcagggccagaccaacagactgcacgacagaatcgtgttcagaagaggcctgcccaccggcgacagccccctgggccccatgacccacagaggcgaggaggactggctgtacgagagactggccccctag

SEQ ID NO: 95920 - DNA, 732 bp, Artificial Sequence
  Description of Artificial Sequence: Synthetic coding sequence
atgacctgctggctgagaggcgtgaccgccaccttcggcagacccgccgagtggcccggctacctgagccacctgtgcggcagaagcgccgccatggacctgggccccatgagaaagagctacagaggcgacagagaggccttcgaggagacccacctgaccagcctggaccccgtgaagcagttcgccgcctggttcgaggaggccgtgcagtgccccgacatcggcgaggccaacgccatgtgcctggccacctgcaccagagacggcaagcccagcgccagaatgctgctgctgaagggcttcggcaaggacggcttcagattcttcaccaacttcgagagcagaaagggcaaggagctggtgagagtggagggccccgtgaagaagctgcccgaggaggaggccgagtgctacttccacagcagacccaagagcagccagatcggcgccgtggtgagccaccagagcagcgtgatccccgacagagagtacctgagaaagaagaacgaggagctggagcagctgtaccaggaccaggaggtgcccaagcccaagagctggggcggctacgtgctgtacccccaggtgatggagttctggcagggccagaccaacagactgcacgacagaatcgtgttcagaagaggcctgcccaccggcgacagccccctgggccccatgacccacagaggcgaggaggactggctgtacgagagactggccccctag

SEQ ID NO: 95921 - DNA, 1098 bp, Artificial Sequence
  Description of Artificial Sequence: Synthetic coding sequence
atggccagcaccgagagcagcctgctgagaagcctgggcctgagccccggccccggcagcagcgaggtggagctggactgctggttcgacgaggacttcaagttcatcctgctgcccgtgagctacgccgtggtgttcgtgctgggcctgggcctgaacgcccccaccctgtggctgttcatcttcagactgagaccctgggacgccaccgccacctacatgttccacctggccctgagcgacaccctgtacgtgctgagcctgcccaccctgatctactactacgccgcccacaaccactggcccttcggcaccgagatctgcaagttcgtgagattcctgttctactggaacctgtactgcagcgtgctgttcctgacctgcatcagcgtgcacagatacctgggcatctgccaccccctgagagccctgagatggggcagacccagactggccggcctgctgtgcctggccgtgtggctggtggtggccggctgcctggtgcccaacctgttcttcgtgaccaccagcaacaagggcaccaccgtgctgtgccacgacaccaccagacccgaggagttcgaccactacgtgcacttcagcagcgccgtgatgggcctgctgttcggcgtgccctgcctggtgaccctggtgtgctacggcctgatggccagaagactgtaccagcccctgcccggcagcgcccagagcagcagcagactgagaagcctgagaaccatcgccgtggtgctgaccgtgttcgccgtgtgcttcgtgcccttccacatcaccagaaccatctactacctggccagactgctggaggccgactgcagagtgctgaacatcgtgaacgtggtgtacaaggtgaccagacccctggccagcgccaacagctgcctggaccccgtgctgtacctgctgaccggcgacaagtacagaagacagctgagacagctgtgcggcggcggcaagccccagcccagaaccgccgccagcagcctggccctggtgagcctgcccgaggacagcagctgcagatgggccgccaccccccaggacagcagctgcagcacccccagagccgacagactgtag

SEQ ID NO: 95922 - DNA, 987 bp, Artificial Sequence
  Description of Artificial Sequence: Synthetic coding sequence
atggagtgggacaacggcaccggccaggccctgggcctgccccccaccacctgcgtgtacagagagaacttcaagcagctgctgctgccccccgtgtacagcgccgtgctggccgccggcctgcccctgaacatctgcgtgatcacccagatctgcaccagcagaagagccctgaccagaaccgccgtgtacaccctgaacctggccctggccgacctgctgtacgcctgcagcctgcccctgctgatctacaactacgcccagggcgaccactggcccttcggcgacttcgcctgcagactggtgagattcctgttctacgccaacctgcacggcagcatcctgttcctgacctgcatcagcttccagagatacctgggcatctgccaccccctggccccctggcacaagagaggcggcagaagagccgcctggctggtgtgcgtggccgtgtggctggccgtgaccacccagtgcctgcccaccgccatcttcgccgccaccggcatccagagaaacagaaccgtgtgctacgacctgagcccccccgccctggccacccactacatgccctacggcatggccctgaccgtgatcggcttcctgctgcccttcgccgccctgctggcctgctactgcctgctggcctgcagactgtgcagacaggacggccccgccgagcccgtggcccaggagagaagaggcaaggccgccagaatggccgtggtggtggccgccgccttcgccatcagcttcctgcccttccacatcaccaagaccgcctacctggccgtgagaagcacccccggcgtgccctgcaccgtgctggaggccttcgccgccgcctacaagggcaccagacccttcgccagcgccaacagcgtgctggaccccatcctgttctacttcacccagaagaagttcagaagaagaccccacgagctgctgcagaagctgaccgccaagtggcagagacagggcagatag

SEQ ID NO: 95923 - DNA, 987 bp, Artificial Sequence; identical to SEQ ID NO: 95922
  Description of Artificial Sequence: Synthetic coding sequence

SEQ ID NO: 95924 - DNA, 987 bp, Artificial Sequence; identical to SEQ ID NO: 95922
  Description of Artificial Sequence: Synthetic coding sequence

SEQ ID NO: 95925 - DNA, 987 bp, Artificial Sequence; identical to SEQ ID NO: 95922
  Description of Artificial Sequence: Synthetic coding sequence

SEQ ID NO: 95926 - DNA, 738 bp, Artificial Sequence
  Description of Artificial Sequence: Synthetic coding sequence
atggagtgggacaacggcaccggccaggccctgggcctgccccccaccacctgcgtgtacagagagaacttcaagcagctgctgctgccccccgtgtacagcgccgtgctggccgccggcctgcccctgaacatctgcgtgatcacccagatctgcaccagcagaagagccctgaccagaaccgccgtgtacaccctgaacctggccctggccgacctgctgtacgcctgcagcctgcccctgctgatctacaactacgcccagggcgaccactggcccttcggcgacttcgcctgcagactggtgagattcctgttctacgccaacctgcacggcagcatcctgttcctgacctgcatcagcttccagagatacctgggcatctgccaccccctggccccctggcacaagagaggcggcagaagagccgcctggctggtgtgcgtggccgtgtggctggccgtgaccacccagtgcctgcccaccgccatcttcgccgccaccggcatccagagaaacagaaccgtgtgctacgacctgagcccccccgccctggccacccactacatgccctacggcatggccctgaccgtgatcggcttcctgctgcccttcgccgccctgctggcctgctactgcctgctggcctgcagactgtgcagacaggacggccccgccgagcccgtggcccaggagagaagaggcaaggccgccagaatggccgtggtggtggcctag

SEQ ID NO: 95927 - DNA, 987 bp, Artificial Sequence; identical to SEQ ID NO: 95922
  Description of Artificial Sequence: Synthetic coding sequence

SEQ ID NO: 95928 - DNA, 987 bp, Artificial Sequence; identical to SEQ ID NO: 95922
  Description of Artificial Sequence: Synthetic coding sequence

SEQ ID NO: 95929 - DNA, 987 bp, Artificial Sequence; identical to SEQ ID NO: 95922
  Description of Artificial Sequence: Synthetic coding sequence

SEQ ID NO: 95930 - DNA, 987 bp, Artificial Sequence; identical to SEQ ID NO: 95922
  Description of Artificial Sequence: Synthetic coding sequence

SEQ ID NO: 95931 - DNA, 387 bp, Artificial Sequence
  Description of Artificial Sequence: Synthetic coding sequence
atggagtgggacaacggcaccggccaggccctgggcctgccccccaccacctgcgtgtacagagagaacttcaagcagctgctgctgccccccgtgtacagcgccgtgctggccgccggcctgcccctgaacatctgcgtgatcacccagatctgcaccagcagaagagccctgaccagaaccgccgtgtacaccctgaacctggccctggccgacctgctgtacgcctgcagcctgcccctgctgatctacaactacgcccagggcgaccactggcccttcggcgacttcgcctgcagactggtgagattcctgttctacgccaacctgcacggcagcatcctgttcctgacctgcatcagcttccagagatacctgggcatctag

SEQ ID NO: 95932 - DNA, 738 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtggccaacaagatcgagagcatccccgtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagagaagcaagatgagcaaggagcagaccagacccagctgcagcgccggcgccagcaccagcaccgccatgggcagaagcccccccccccagaccagcagcagcgccccccccaacaccagcagcaccgaggcctacctgatgaacctgaccctgagcctgaccgccggcagcttcctgagctgcgccgtgtggggcagagacagagagctgagaaacctggagctgagcgccaccgacagcctgagcaccgcccccatctactacacccccatccccttcgcccactag

SEQ ID NO: 95933 - DNA, 1452 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagagaagcaagatgagcaaggagcagaccagacccagctgcagcgccggcgccagcaccagcaccgccatgggcagaagcccccccccccagaccagcagcagcgccccccccaacaccagcagcaccgagagcctgaagcccctggccaacagacacgccaccgccagcaagaacatcttcagagaggaccccatcatcgccatggtgctgaacgccaccaaggtgttcaagtacgagagcagcgagaacgagcagagaagaatgttccacgccaccgtggccacccagacccagttcttccacgtgaaggtgctgaacatcaacctgaagagaaagttcatcaagaagagaatcatcatcatcagcaactacagcaagagaaacagcctgctggaggtgaacgaggccagcagcgtgagcgaggccggccccgaccagaccttcgaggtgcccaaggacatcatcagaagagccaagaagatccccaagatcaacatcctgcacaagcagaccagcggctacatcgtgtacggcctgttcatgctgcacaccaagatcgtgaacagaaagaccaccatctacgagatccaggacaagaccggcagcatggccgtggtgggcaagggcgagtgccacaacatcccctgcgagaagggcgacaagctgagactgttctgcttcagactgagaaagagagagaacatgagcaagctgatgagcgagatgcacagcttcatccagatccagaagaacaccaaccagagaagccacgacagcagaagcatggccctgccccaggagcagagccagcaccccaagcccagcgaggccagcaccaccctgcccgagagccacctgaagaccccccagatgccccccaccacccccagcagcagcagcttcaccaagaaggacgagacccaccccggcgcccagagcagccccgccaacttcagaatcaccagccccaccgtggccccccccctgagcagcgacaccagcaccaacagacaccccgccgtgccctag

SEQ ID NO: 95934 - DNA, 1479 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtggccaacaagatcgagagcatccccgtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagagaagcaagatgagcaaggagcagaccagacccagctgcagcgccggcgccagcaccagcaccgccatgggcagaagcccccccccccagaccagcagcagcgccccccccaacaccagcagcaccgagagcctgaagcccctggccaacagacacgccaccgccagcaagaacatcttcagagaggaccccatcatcgccatggtgctgaacgccaccaaggtgttcaagtacgagagcagcgagaacgagcagagaagaatgttccacgccaccgtggccacccagacccagttcttccacgtgaaggtgctgaacatcaacctgaagagaaagttcatcaagaagagaatcatcatcatcagcaactacagcaagagaaacagcctgctggaggtgaacgaggccagcagcgtgagcgaggccggccccgaccagaccttcgaggtgcccaaggacatcatcagaagagccaagaagatccccaagatcaacatcctgcacaagcagaccagcggctacatcgtgtacggcctgttcatgctgcacaccaagatcgtgaacagaaagaccaccatctacgagatccaggacaagaccggcagcatggccgtggtgggcaagggcgagtgccacaacatcccctgcgagaagggcgacaagctgagactgttctgcttcagactgagaaagagagagaacatgagcaagctgatgagcgagatgcacagcttcatccagatccagaagaacaccaaccagagaagccacgacagcagaagcatggccctgccccaggagcagagccagcaccccaagcccagcgaggccagcaccaccctgcccgagagccacctgaagaccccccagatgccccccaccacccccagcagcagcagcttcaccaagaaggacgagacccaccccggcgcccagagcagccccgccaacttcagaatcaccagccccaccgtggccccccccctgagcagcgacaccagcaccaacagacaccccgccgtgccctag

SEQ ID NO: 95935 - DNA, 1359 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagagaagcaagatgagcaaggagcagaccagacccagctgcagcgccggcgccagcaccagcaccgccatgggcagaagcccccccccccagaccagcagcagcgccccccccaacaccagcagcaccgagagcctgaagcccctggccaacagacacgccaccgccagcaagaacatcttcagagaggaccccatcatcgccatggtgctgaacgccaccaaggtgttcaagtacgagagcagcgagaacgagcagagaagaatgttccacgccaccgtggccacccagacccagttcttccacgtgaaggtgctgaacatcaacctgaagagaaagttcatcaagaagagaatcatcatcatcagcaactacagcaagagaaacagcctgctggaggtgaacgaggccagcagcgtgagcgaggccggccccgaccagaccttcgaggtgcccaaggacatcatcagaagagccaagaagatccccaagatcaacatcctgcacaagcagaccagcggctacatcgtgtacggcctgttcatgctgcacaccaagatcgtgaacagaaagaccaccatctacgagatccaggacaagaccggcagcatggccgtggtgggcaagggcgagtgccacaacatcccctgcgagaagggcgacaagctgagactgttctgcttcagactgagaaagagagagaacatgagcaagctgatgagcgagatgcacagcttcatccagatccagaagaacaccaaccagagaagccacgacagcagaagcatggccctgccccaggagcagagccagcaccccaagcccagcgaggccagcaccaccctgcccgagagccacctgaagaccccccagatgccccccaccacccccagcagcagcagcttcaccaaggtgaccaaggacaaggacatcaagtag

SEQ ID NO: 95936 - DNA, 1386 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtggccaacaagatcgagagcatccccgtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagagaagcaagatgagcaaggagcagaccagacccagctgcagcgccggcgccagcaccagcaccgccatgggcagaagcccccccccccagaccagcagcagcgccccccccaacaccagcagcaccgagagcctgaagcccctggccaacagacacgccaccgccagcaagaacatcttcagagaggaccccatcatcgccatggtgctgaacgccaccaaggtgttcaagtacgagagcagcgagaacgagcagagaagaatgttccacgccaccgtggccacccagacccagttcttccacgtgaaggtgctgaacatcaacctgaagagaaagttcatcaagaagagaatcatcatcatcagcaactacagcaagagaaacagcctgctggaggtgaacgaggccagcagcgtgagcgaggccggccccgaccagaccttcgaggtgcccaaggacatcatcagaagagccaagaagatccccaagatcaacatcctgcacaagcagaccagcggctacatcgtgtacggcctgttcatgctgcacaccaagatcgtgaacagaaagaccaccatctacgagatccaggacaagaccggcagcatggccgtggtgggcaagggcgagtgccacaacatcccctgcgagaagggcgacaagctgagactgttctgcttcagactgagaaagagagagaacatgagcaagctgatgagcgagatgcacagcttcatccagatccagaagaacaccaaccagagaagccacgacagcagaagcatggccctgccccaggagcagagccagcaccccaagcccagcgaggccagcaccaccctgcccgagagccacctgaagaccccccagatgccccccaccacccccagcagcagcagcttcaccaaggtgaccaaggacaaggacatcaagtag

SEQ ID NO: 95937 - DNA, 453 bp, Artificial Sequence
  Description of Artificial Sequence: Synthetic coding sequence
atggccaacaactacaagaagatcgtgctgctgaagggcctggaggtgatcaacgactaccacttcagaatcgtgaagagcctgctgagcaacgacctgaagctgaaccccaagatgaaggaggagtacgacaagatccagatcgccgacctgatggaggagaagttccccggcgacgccggcctgggcaagctgatcgagttcttcaaggagatccccaccctgggcgacctggccgagaccctgaagagagagaagctgaaggtggccaacaagatcgagagcatccccgtgaagggcatcatccccagcaagaagaccaagcagaaggaggtgtaccccgccacccccgcctgcacccccagcaacagactgaccgccaagggcgccgaggagaccctgggcccccagaagagaaagaagcccagcgaggaggagaccggcaccaagtag

SEQ ID NO: 95938 - DNA, 399 bp, Artificial Sequence
  Description of Artificial Sequence: Synthetic coding sequence
atggccaccaccgtgaccctggagaagtgcggccacaacaagggctacaagggcctggacaactgcagattctgccccggcagccagtgctgcgtggaggacggccccgagagcatcgacagcatcatcgacatggacgccgtgtgcaagagagtgaccaccctgggcctggacgtgagcgtgaccatcagccaggacgccggcagatacctgtgcgacttcacctactacaccagcctgtaccagagccacggcagaagcgccttcgtgcacgtgccccccctgggcaagccctacaacgccgaccagctgggcagagccctgagagccatcatcgaggagatgctggacctgctggagcagagcgagggcaagatcaactactgccacaagcactag

SEQ ID NO: 95939 - DNA, 630 bp, Artificial Sequence
  Description of Artificial Sequence: Synthetic coding sequence
atggagcagcccagaaaggccgtggtggtgaccggcttcggccccttcggcgagcacaccgtgaacgccagctggatcgccgtgcaggagctggagaagctgggcctgggcgacagcgtggacctgcacgtgtacgagatccccgtggagtaccagaccgtgcagagactgatccccgccctgtgggagaagcacagcccccagctggtggtgcacgtgggcgtgagcggcatggccaccaccgtgaccctggagaagtgcggccacaacaagggctacaagggcctggacaactgcagattctgccccggcagccagtgctgcgtggaggacggccccgagagcatcgacagcatcatcgacatggacgccgtgtgcaagagagtgaccaccctgggcctggacgtgagcgtgaccatcagccaggacgccggcagatacctgtgcgacttcacctactacaccagcctgtaccagagccacggcagaagcgccttcgtgcacgtgccccccctgggcaagccctacaacgccgaccagctgggcagagccctgagagccatcatcgaggagatgctggacctgctggagcagagcgagggcaagatcaactactgccacaagcactag

SEQ ID NO: 95940 - DNA, 609 bp, Artificial Sequence
  Description of Artificial Sequence: Synthetic coding sequence
atgaagaaggccagaaacgacgagtacgagaacctgttcaacatgatcgtggagatccccagatggaccaacgccaagatggagatcgccaccaaggagcccatgaaccccatcaagcagtacgtgaaggacggcaagctgagatacgtggccaacatcttcccctacaagggctacatctggaactacggcaccctgccccagacctgggaggacccccacgagaaggacaagagcaccaactgcttcggcgacaacgaccccatcgacgtgtgcgagatcggcagcaagatcctgagctgcggcgaggtgatccacgtgaagatcctgggcatcctggccctgatcgacgagggcgagaccgactggaagctgatcgccatcaacgccaacgaccccgaggccagcaagttccacggcctgagaaacatccccgtgtacaccatcaacagaatcgtgatcctgcccagcctggacagaagccagaccagcagcctgagctacctgcccgcccaccaggacagctgcgtgcccctggacgccgccctgcacgtggtgctgtacttctgcagcctgctgggcctgcagagctacctgagctgcttctag

SEQ ID NO: 95941 - DNA, 1005 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaagaacgtgaccggccactacatcagccccttccacgacatccccctgaaggtgaacagcaaggaggagaacggcatccccatgaagaaggccagaaacgacgagtacgagaacctgttcaacatgatcgtggagatccccagatggaccaacgccaagatggagatcgccaccaaggagcccatgaaccccatcaagcagtacgtgaaggacggcaagctgagatacgtggccaacatcttcccctacaagggctacatctggaactacggcaccctgccccagacctgggaggacccccacgagaaggacaagagcaccaactgcttcggcgacaacgaccccatcgacgtgtgcgagatcggcagcaagatcctgagctgcggcgaggtgatccacgtgaagatcctgggcatcctggccctgatcgacgagggcgagaccgactggaagctgatcgccatcaacgccaacgaccccgaggccagcaagttccacgacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95942 - DNA, 918 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaagaacgtgaccggccactacatcagccccttccacgacatccccctgaaggtgaacagcaaggaggagaacggcatccccatgaagaaggccagaaacgacgagtacgagaacctgttcaacatgatcgtggagatccccagatggaccaacgccaagatggagatcgccaccaaggagcccatgaaccccatcaagcagtacgtgaaggacggcaagctgagatacgtggccaacatcttcccctacaagggctacatctggaactacggcaccctgccccagatcctgagctgcggcgaggtgatccacgtgaagatcctgggcatcctggccctgatcgacgagggcgagaccgactggaagctgatcgccatcaacgccaacgaccccgaggccagcaagttccacgacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95943 - DNA, 507 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95944 - DNA, 1050 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaagaacgtgaccggccactacatcagccccttccacgacatccccctgaaggtgaacagcaaggaggacaccgaggcccagggcatcttcatcgacctgagcaagatctgggagaacggcatccccatgaagaaggccagaaacgacgagtacgagaacctgttcaacatgatcgtggagatccccagatggaccaacgccaagatggagatcgccaccaaggagcccatgaaccccatcaagcagtacgtgaaggacggcaagctgagatacgtggccaacatcttcccctacaagggctacatctggaactacggcaccctgccccagacctgggaggacccccacgagaaggacaagagcaccaactgcttcggcgacaacgaccccatcgacgtgtgcgagatcggcagcaagatcctgagctgcggcgaggtgatccacgtgaagatcctgggcatcctggccctgatcgacgagggcgagaccgactggaagctgatcgccatcaacgccaacgaccccgaggccagcaagttccacgacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95945 - DNA, 951 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaagaacgtgaccggccactacatcagccccttccacgacatccccctgaaggtgaacagcaaggaggagaacggcatccccatgaagaaggccagaaacgacgagtacgagatcgccaccaaggagcccatgaaccccatcaagcagtacgtgaaggacggcaagctgagatacgtggccaacatcttcccctacaagggctacatctggaactacggcaccctgccccagacctgggaggacccccacgagaaggacaagagcaccaactgcttcggcgacaacgaccccatcgacgtgtgcgagatcggcagcaagatcctgagctgcggcgaggtgatccacgtgaagatcctgggcatcctggccctgatcgacgagggcgagaccgactggaagctgatcgccatcaacgccaacgaccccgaggccagcaagttccacgacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95946 - DNA, 699 bp, Artificial Sequence
  Description of Artificial Sequence: Synthetic coding sequence
atgagcgccctgctgagactgctgagaaccggcgcccccgccgccgcctgcctgagactgggcaccagcgccggcaccggcagcagaagagccatggccctgtaccacaccgaggagagaggccagccctgcagccagaactacagactgttcttcaagaacgtgaccggccactacatcagccccttccacgacatccccctgaaggtgaacagcaaggagatcctgagctgcggcgaggtgatccacgtgaagatcctgggcatcctggccctgatcgacgagggcgagaccgactggaagctgatcgccatcaacgccaacgaccccgaggccagcaagttccacgacatcgacgacgtgaagaagttcaagcccggctacctggaggccaccctgaactggttcagactgtacaaggtgcccgacggcaagcccgagaaccagttcgccttcaacggcgagttcaagaacaaggccttcgccctggaggtgatcaagagcacccaccagtgctggaaggccctgctgatgaagaagtgcaacggcggcgccatcaactgcaccaacgtgcagatcagcgacagccccttcagatgcacccaggaggaggccagaagcctggtggagagcgtgagcagcagccccaacaaggagagcaacgaggaggagcaggtgtggcacttcctgggcaagtag

SEQ ID NO: 95947 - DNA, 960 bp, Artificial Sequence
  Description of Artificial Sequence: Synthetic coding sequence
atgagcgtgggcttcatcggcgccggccagctggccttcgccctggccaagggcttcaccgccgccggcgtgctggccgcccacaagatcatggccagcagccccgacatggacctggccaccgtgagcgccctgagaaagatgggcgtgaagctgaccccccacaacaaggagaccgtgcagcacagcgacgtgctgttcctggccgtgaagccccacatcatccccttcatcctggacgagatcggcgccgacatcgaggacagacacatcgtggtgagctgcgccgccggcgtgaccatcagcagcatcgagaagaagctgagcgccttcagacccgcccccagagtgatcagatgcatgaccaacacccccgtggtggtgagagagggcgccaccgtgtacgccaccggcacccacgcccaggtggaggacggcagactgatggagcagctgctgagcagcgtgggcttctgcaccgaggtggaggaggacctgatcgacgccgtgaccggcctgagcggcagcggccccgcctacgccttcaccgccctggacgccctggccgacggcggcgtgaagatgggcctgcccagaagactggccgtgagactgggcgcccaggccctgctgggcgccgccaagatgctgctgcacagcgagcagcaccccggccagctgaaggacaacgtgagcagccccggcggcgccaccatccacgccctgcacgtgctggagagcggcggcttcagaagcctgctgatcaacgccgtggaggccagctgcatcagaaccagagagctgcagagcatggccgaccaggagcaggtgagccccgccgccatcaagaagaccatcctggacaaggtgaagctggacagccccgccggcaccgccctgagccccagcggccacaccaagctgctgcccagaagcctggcccccgccggcaaggactag

SEQ ID NO: 95948 - DNA, 951 bp, Artificial Sequence
  Description of Artificial Sequence: Synthetic coding sequence
atgagcgtgggcttcatcggcgccggccagctggccttcgccctggccaagggcttcaccgccgccggcgtgctggccgcccacaagatcatggccagcagccccgacatggacctggccaccgtgagcgccctgagaaagatgggcgtgaagctgaccccccacaacaaggagaccgtgcagcacagcgacgtgctgttcctggccgtgaagccccacatcatccccttcatcctggacgagatcggcgccgacatcgaggacagacacatcgtggtgagctgcgccgccggcgtgaccatcagcagcatcgagaagaagctgagcgccttcagacccgcccccagagtgatcagatgcatgaccaacacccccgtggtggtgagagagggcgccaccgtgtacgccaccggcacccacgcccaggtggaggacggcagactgatggagcagctgctgagcagcgtgggcttctgcaccgaggtggaggaggacctgatcgacgccgtgaccggcctgagcggcagcggccccgcctacgccttcaccgccctggacgccctggccgacggcggcgtgaagatgggcctgcccagaagactggccgtgagactgggcgcccaggccctgctgggcgccgccaagatgctgctgcacagcgagcagcaccccggccagctgaaggacaacgtgagcagccccggcggcgccaccatccacgccctgcacgtgctggagagcggcggcttcagaagcctgctgatcaacgccgtggaggccagctgcatcagaaccagagagctgcagagcatggccgaccaggagcaggtgagccccgccgccatcaagaagaccatcctggacaaggaccacctgcccctggagctgggcagccccgagggcctgcaccccctgctgctgcagtaccagctggccagagcccccagctag

SEQ ID NO: 95949 - DNA, 1041 bp, Artificial Sequence
  Description of Artificial Sequence: Synthetic coding sequence
atggtgggcggcggcagaagagtgggcagagacgagcccgtgcccagcgtgggcgccctgggccagggcagccccgacagcatgagcgtgggcttcatcggcgccggccagctggccttcgccctggccaagggcttcaccgccgccggcgtgctggccgcccacaagatcatggccagcagccccgacatggacctggccaccgtgagcgccctgagaaagatgggcgtgaagctgaccccccacaacaaggagaccgtgcagcacagcgacgtgctgttcctggccgtgaagccccacatcatccccttcatcctggacgagatcggcgccgacatcgaggacagacacatcgtggtgagctgcgccgccggcgtgaccatcagcagcatcgagaagaagctgagcgccttcagacccgcccccagagtgatcagatgcatgaccaacacccccgtggtggtgagagagggcgccaccgtgtacgccaccggcacccacgcccaggtggaggacggcagactgatggagcagctgctgagcagcgtgggcttctgcaccgaggtggaggaggacctgatcgacgccgtgaccggcctgagcggcagcggccccgcctacgccttcaccgccctggacgccctggccgacggcggcgtgaagatgggcctgcccagaagactggccgtgagactgggcgcccaggccctgctgggcgccgccaagatgctgctgcacagcgagcagcaccccggccagctgaaggacaacgtgagcagccccggcggcgccaccatccacgccctgcacgtgctggagagcggcggcttcagaagcctgctgatcaacgccgtggaggccagctgcatcagaaccagagagctgcagagcatggccgaccaggagcaggtgagccccgccgccatcaagaagaccatcctggacaaggtgaagctggacagccccgccggcaccgccctgagccccagcggccacaccaagctgctgcccagaagcctggcccccgccggcaaggactag

SEQ ID NO: 95950 - DNA, 819 bp, Artificial Sequence
  Description of Artificial Sequence: Synthetic coding sequence
atgagcgtgggcttcatcggcgccggccagctggccttcgccctggccaagggcttcaccgccgccggcgtgctggccgcccacaagatcatggccagcagccccgacatggacctggccaccgtgagcgccctgagaaagatgggcgtgaagctgaccccccacaacaaggagaccgtgcagcacagcgacgtgctgttcctggccgtgaagccccacatcatccccttcatcctggacgagatcggcgccgacatcgaggacagacacatcgtggtgagctgcgccgccggcgtgaccatcagcagcatcgagaagaagctgagcgccttcagacccgcccccagagtgatcagatgcatgaccaacacccccgtggtggtgagagagggcgccaccgtgtacgccaccggcacccacgcccaggtggaggacggcagactgatggagcagctgctgagcagcgtgggcttctgcaccgaggtggaggaggacctgatcgacgccgtgaccggcctgagcggcagcggccccgcctacgccttcaccgccctggacgccctggccgacggcggcgtgaagatgggcctgcccagaagactggccgtgagactgggcgcccaggccctgctgggcggctgccaggacgccgccgccctgagaaccgcccccagacccgcccagggccagagacagctgagctggtggggccaccacccctgcctggcctgcgccggcgagtggggcctgcccctgcccgcccaccagagatgcggcggcctgctgcacccccacaccggcgccgccgtgcacggctag

SEQ ID NO: 95951 - DNA, 723 bp, Artificial Sequence
  Description of Artificial Sequence: Synthetic coding sequence
atgagcgtgggcttcatcggcgccggccagctggccttcgccctggccaagggcttcaccgccgccggcgtgctggccgcccacaagatcatggccagcagccccgacatggacctggccaccgtgagcgccctgagaaagatgggcgtgaagctgaccccccacaacaaggagaccgtgcagcacagcgacgtgctgttcctggccgtgaagccccacatcatcagcatcgagaagctgagcgccttcagacccgcccccagagtgatcagatgcatgaccaacacccccgtggtggtgagagagggcgccaccgtgtacgccaccggcacccacgcccaggtggaggacggcagactgatggagcagctgctgagcagcgtgggcttctgcaccgaggtggaggaggacctgatcgacgccgtgaccggcctgagcggcagcggccccgcctacggcgccgccaagatgctgctgcacagcgagcagcaccccggccagctgaaggacaacgtgagcagccccggcggcgccaccatccacgccctgcacgtgctggagagcggcggcttcagaagcctgctgatcaacgccgtggaggccagctgcatcagaaccagatgggcccccgccctgcccgccagcctggtgagcagcccctgcatggccgaggccagcctgacccacatctgcagcttcacccacagcgccgacacctactag

SEQ ID NO: 95952 - DNA, 1590 bp, Artificial Sequence
  Description of Artificial Sequence: Synthetic coding sequence
atgctgaagttcagaaccgtgcacggcggcctgagactgctgggcatcagaagaaccagcaccgcccccgccgccagccccaacgtgagaagactggagtacaagcccatcaagaaggtgatggtggccaacagaggcgagatcgccatcagagtgttcagagcctgcaccgagctgggcatcagaaccgtggccatctacagcgagcaggacaccggccagatgcacagacagaaggccgacgaggcctacctgatcggcagaggcctggcccccgtgcaggcctacctgcacatccccgacatcatcaaggtggccaaggagaacaacgtggacgccgtgcaccccggctacggcttcctgagcgagagagccgacttcgcccaggcctgccaggacgccggcgtgagattcatcggccccagccccgaggtggtgagaaagatgggcgacaaggtggaggccagagccatcgccatcgccgccggcgtgcccgtggtgcccggcaccgacgcccccatcaccagcctgcacgaggcccacgagttcagcaacacctacggcttccccatcatcttcaaggccgcctacggcggcggcggcagaggcatgagagtggtgcacagctacgaggagctggaggagaactacaccagagcctacagcgaggccctggccgccttcggcaacggcgccctgttcgtggagaagttcatcgagaagcccagacacatcgaggtgcagatcctgggcgaccagtacggcaacatcctgcacctgtacgagagagactgcagcatccagagaagacaccagaaggtggtggagatcgcccccgccgcccacctggacccccagctgagaaccagactgaccagcgacagcgtgaagctggccaagcaggtgggctacgagaacgccggcaccgtggagttcctggtggacagacacggcaagcactacttcatcgaggtgaacagcagactgcaggtggagcacaccgtgaccgaggagatcaccgacgtggacctggtgcacgcccagatccacgtggccgagggcagaagcctgcccgacctgggcctgagacaggagaacatcagaatcaacggctgcgccatccagtgcagagtgaccaccgaggaccccgccagaagcttccagcccgacaccggcagaatcgaggtgttcagaagcggcgagggcatgggcatcagactggacaacgccagcgccttccagggcgccgtgatcagcccccactacgacagcctgctggtgaaggtgatcgcccacggcaaggaccaccccaccgccgccaccaagatgagcagagccctggccgagttcagagtgagaggcgtgaaggtgagaagacaccaggcccagcccctggccgccgccctgggcagaccctgcggccaggaggccagaagaccccaggccgccgtgaccgcccccaccggccccggcagccccaccctggtgagagtgccccccgccgccagagtgctgagcagcagactgggcggccccagccagaccacccccgagaccagcaccgaggtgagccccaccatcctgctgtag

SEQ ID NO: 95953 - DNA, 3537 bp, Artificial Sequence
  Description of Artificial Sequence: Synthetic coding sequence
atgctgaagttcagaaccgtgcacggcggcctgagactgctgggcatcagaagaaccagcaccgcccccgccgccagccccaacgtgagaagactggagtacaagcccatcaagaaggtgatggtggccaacagaggcgagatcgccatcagagtgttcagagcctgcaccgagctgggcatcagaaccgtggccatctacagcgagcaggacaccggccagatgcacagacagaaggccgacgaggcctacctgatcggcagaggcctggcccccgtgcaggcctacctgcacatccccgacatcatcaaggtggccaaggagaacaacgtggacgccgtgcaccccggctacggcttcctgagcgagagagccgacttcgcccaggcctgccaggacgccggcgtgagattcatcggccccagccccgaggtggtgagaaagatgggcgacaaggtggaggccagagccatcgccatcgccgccggcgtgcccgtggtgcccggcaccgacgcccccatcaccagcctgcacgaggcccacgagttcagcaacacctacggcttccccatcatcttcaaggccgcctacggcggcggcggcagaggcatgagagtggtgcacagctacgaggagctggaggagaactacaccagagcctacagcgaggccctggccgccttcggcaacggcgccctgttcgtggagaagttcatcgagaagcccagacacatcgaggtgcagatcctgggcgaccagtacggcaacatcctgcacctgtacgagagagactgcagcatccagagaagacaccagaaggtggtggagatcgcccccgccgcccacctggacccccagctgagaaccagactgaccagcgacagcgtgaagctggccaagcaggtgggctacgagaacgccggcaccgtggagttcctggtggacagacacggcaagcactacttcatcgaggtgaacagcagactgcaggtggagcacaccgtgaccgaggagatcaccgacgtggacctggtgcacgcccagatccacgtggccgagggcagaagcctgcccgacctgggcctgagacaggagaacatcagaatcaacggctgcgccatccagtgcagagtgaccaccgaggaccccgccagaagcttccagcccgacaccggcagaatcgaggtgttcagaagcggcgagggcatgggcatcagactggacaacgccagcgccttccagggcgccgtgatcagcccccactacgacagcctgctggtgaaggtgatcgcccacggcaaggaccaccccaccgccgccaccaagatgagcagagccctggccgagttcagagtgagaggcgtgaagaccaacatcgccttcctgcagaacgtgctgaacaaccagcagttcctggccggcaccgtggacacccagttcatcgacgagaaccccgagctgttccagctgagacccgcccagaacagagcccagaagctgctgcactacctgggccacgtgatggtgaacggccccaccacccccatccccgtgaaggccagccccagccccaccgaccccgtggtgcccgccgtgcccatcggccccccccccgccggcttcagagacatcctgctgagagagggccccgagggcttcgccagagccgtgagaaaccaccccggcctgctgctgatggacaccaccttcagagacgcccaccagagcctgctggccaccagagtgagaacccacgacctgaagaagatcgccccctacgtggcccacaacttcagcaagctgttcagcatggagaactggggcggcgccaccttcgacgtggccatgagattcctgtacgagtgcccctggagaagactgcaggagctgagagagctgatccccaacatccccttccagatgctgctgagaggcgccaacgccgtgggctacaccaactaccccgacaacgtggtgttcaagttctgcgaggtggccaaggagaacggcatggacgtgttcagagtgttcgacagcctgaactacctgcccaacatgctgctgggcatggaggccgccggcagcgccggcggcgtggtggaggccgccatcagctacaccggcgacgtggccgaccccagcagaaccaagtacagcctgcagtactacatgggcctggccgaggagctggtgagagccggcacccacatcctgtgcatcaaggacatggccggcctgctgaagcccaccgcctgcaccatgctggtgagcagcctgagagacagattccccgacctgcccctgcacatccacacccacgacaccagcggcgccggcgtggccgccatgctggcctgcgcccaggccggcgccgacgtggtggacgtggccgccgacagcatgagcggcatgaccagccagcccagcatgggcgccctggtggcctgcaccagaggcacccccctggacaccgaggtgcccatggagagagtgttcgactacagcgagtactgggagggcgccagaggcctgtacgccgccttcgactgcaccgccaccatgaagagcggcaacagcgacgtgtacgagaacgagatccccggcggccagtacaccaacctgcacttccaggcccacagcatgggcctgggcagcaagttcaaggaggtgaagaaggcctacgtggaggccaaccagatgctgggcgacctgatcaaggtgacccccagcagcaagatcgtgggcgacctggcccagttcatggtgcagaacggcctgagcagagccgaggccgaggcccaggccgaggagctgagcttccccagaagcgtggtggagttcctgcagggctacatcggcgtgccccacggcggcttccccgagcccttcagaagcaaggtgctgaaggacctgcccagagtggagggcagacccggcgccagcctgccccccctggacctgcaggccctggagaaggagctggtggacagacacggcgaggaggtgacccccgaggacgtgctgagcgccgccatgtaccccgacgtgttcgcccacttcaaggacttcaccgccaccttcggccccctggacagcctgaacaccagactgttcctgcagggccccaagatcgccgaggagttcgaggtggagctggagagaggcaagaccctgcacatcaaggccctggccgtgagcgacctgaacagagccggccagagacaggtgttcttcgagctgaacggccagctgagaagcatcctggtgaaggacacccaggccatgaaggagatgcacttccaccccaaggccctgaaggacgtgaagggccagatcggcgcccccatgcccggcaaggtgatcgacatcaaggtggtggccggcgccaaggtggccaagggccagcccctgtgcgtgctgagcgccatgaagatggagaccgtggtgaccagccccatggagggcaccgtgagaaaggtgcacgtgaccaaggacatgaccctggagggcgacgacctgatcctggagatcgagtag

SEQ ID NO: 95954 - DNA, 3537 bp, Artificial Sequence; identical to SEQ ID NO: 95953
  Description of Artificial Sequence: Synthetic coding sequence

SEQ ID NO: 95955 - DNA, 3537 bp, Artificial Sequence; identical to SEQ ID NO: 95953
  Description of Artificial Sequence: Synthetic coding sequence

SEQ ID NO: 95956 - DNA, 615 bp, Artificial Sequence
  Description of Artificial Sequence: Synthetic coding sequence
atgagaaagatgctggccgccgtgagcagagtgctgagcggcgccagccagaagcccgccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccagttcctgctgcccctgacccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccaggtgcccctgggcgccggcatcgccctggcctgcaagtacaacggcaaggacgaggtgtgcctgaccctgtacggcgacggctag

SEQ ID NO: 95957 - DNA, 330 bp, Artificial Sequence
  Description of Artificial Sequence: Synthetic coding sequence
atggagctgcagacctacagataccacggccacagcatgagcgaccccggcgtgagctacagaaccagagaggagatccaggaggtgagaagcaagagcgaccccatcatgctgctgaaggacagaatggtgaacagcaacctggccagcgtggaggagctgaaggagatcgacgtggaggtgagaaaggagatcgaggacgccgcccagttcgccaccgccgaccccgagccccccctggaggagctgggctaccacatctacagcagcgacccccccttcgaggtgagaggcgccaaccagtggatcaagttcaagagcgtgagctag

SEQ ID NO: 95958 - DNA, 543 bp, Artificial Sequence
  Description of Artificial Sequence: Synthetic coding sequence
atgagaaagatgctggccgccgtgagcagagtgctgagcggcgccagccagaagcccgccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccaggtggtgaaggacgaggactgcgtgctgctgtag

SEQ ID NO: 95959 - DNA, 1287 bp, Artificial Sequence
  Description of Artificial Sequence: Synthetic coding sequence
atgagaaagatgctggccgccgtgagcagagtgctgagcggcgccagccagaagcccagacacggcctggccaccctgcccagcctggtgagcatcagcagactgaagcagagcagccacctgggcctgcccaagtgctgggactacagccacagcctgaagaccagacaggccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccaggtgcccctgggcgccggcatcgccctggcctgcaagtacaacggcaaggacgaggtgtgcctgaccctgtacggcgacggcgccgccaaccagggccagatcttcgaggcctacaacatggccgccctgtggaagctgccctgcatcttcatctgcgagaacaacagatacggcatgggcaccagcgtggagagagccgccgccagcaccgactactacaagagaggcgacttcatccccggcctgagagtggacggcatggacatcctgtgcgtgagagaggccaccagattcgccgccgcctactgcagaagcggcaagggccccatcctgatggagctgcagacctacagataccacggccacagcatgagcgaccccggcgtgagctacagaaccagagaggagatccaggaggtgagaagcaagagcgaccccatcatgctgctgaaggacagaatggtgaacagcaacctggccagcgtggaggagctgaaggagatcgacgtggaggtgagaaaggagatcgaggacgccgcccagttcgccaccgccgaccccgagccccccctggaggagctgggctaccacatctacagcagcgacccccccttcgaggtgagaggcgccaaccagtggatcaagttcaagagcgtgagctag

SEQ ID NO: 95960 - DNA, 366 bp, Artificial Sequence
  Description of Artificial Sequence: Synthetic coding sequence
atgagaaagatgctggccgccgtgagcagagtgctgagcggcgccagccagaagcccttcgccggcagccccccccccagacacctgaccgtgggcagaaagctgagcagcagatacgaggtgaccttcgagagcgcccaggccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtag

SEQ ID NO: 95961 - DNA, 366 bp, Artificial Sequence; identical to SEQ ID NO: 95960
  Description of Artificial Sequence: Synthetic coding sequence

SEQ ID NO: 95962 - DNA, 1173 bp, Artificial Sequence
  Description of Artificial Sequence: Synthetic coding sequence
atgagaaagatgctggccgccgtgagcagagtgctgagcggcgccagccagaagcccgccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccaggtgcccctgggcgccggcatcgccctggcctgcaagtacaacggcaaggacgaggtgtgcctgaccctgtacggcgacggcgccgccaaccagggccagatcttcgaggcctacaacatggccgccctgtggaagctgccctgcatcttcatctgcgagaacaacagatacggcatgggcaccagcgtggagagagccgccgccagcaccgactactacaagagaggcgacttcatccccggcctgagagtggacggcatggacatcctgtgcgtgagagaggccaccagattcgccgccgcctactgcagaagcggcaagggccccatcctgatggagctgcagacctacagataccacggccacagcatgagcgaccccggcgtgagctacagaaccagagaggagatccaggaggtgagaagcaagagcgaccccatcatgctgctgaaggacagaatggtgaacagcaacctggccagcgtggaggagctgaaggagatcgacgtggaggtgagaaaggagatcgaggacgccgcccagttcgccaccgccgaccccgagccccccctggaggagctgggctaccacatctacagcagcgacccccccttcgaggtgagaggcgccaaccagtggatcaagttcaagagcgtgagctag

SEQ ID NO: 95963 - DNA, 618 bp, Artificial Sequence
  Description of Artificial Sequence: Synthetic coding sequence
atgagaaagatgctggccgccgtgagcagagtgctgagcggcgccagccagaagcccagacacggcctggccaccctgcccagcctggtgagcatcagcagactgaagcagagcagccacctgggcctgcccaagtgctgggactacagccacagcctgaagaccagacaggccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgtag

SEQ ID NO: 95964 - DNA, 1080 bp, Artificial Sequence
  Description of Artificial Sequence: Synthetic coding sequence
atgagaaagatgctggccgccgtgagcagagtgctgagcggcgccagccagaagcccgccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccagggccagatcttcgaggcctacaacatggccgccctgtggaagctgccctgcatcttcatctgcgagaacaacagatacggcatgggcaccagcgtggagagagccgccgccagcaccgactactacaagagaggcgacttcatccccggcctgagagtggacggcatggacatcctgtgcgtgagagaggccaccagattcgccgccgcctactgcagaagcggcaagggccccatcctgatggagctgcagacctacagataccacggccacagcatgagcgaccccggcgtgagctacagaaccagagaggagatccaggaggtgagaagcaagagcgaccccatcatgctgctgaaggacagaatggtgaacagcaacctggccagcgtggaggagctgaaggagatcgacgtggaggtgagaaaggagatcgaggacgccgcccagttcgccaccgccgaccccgagccccccctggaggagctgggctaccacatctacagcagcgacccccccttcgaggtgagaggcgccaaccagtggatcaagttcaagagcgtgagctag

SEQ ID NO: 95965 - DNA, 129 bp, Artificial Sequence
  Description of Artificial Sequence: Synthetic coding sequence
gccaaccagtggatcaagttcaagagcgtgaagggcagaagaagaagaggctacaccttcagaggcctgcccgacagcgtgctgaacctggtgaaggaggaggagaaccccgtgaacgagatccagtag

SEQ ID NO: 95966 - DNA, 1194 bp, Artificial Sequence
  Description of Artificial Sequence: Synthetic coding sequence
atgagaaagatgctggccgccgtgagcagagtgctgagcggcgccagccagaagcccgccagcagagtgctggtggccagcagaaacttcgccaacgacgccaccttcgagatcaagaagtgcgacctgcacagactggaggagggcccccccgtgaccaccgtgctgaccagagaggacggcctgaagtactacagaatgatgcagaccgtgagaagaatggagctgaaggccgaccagctgtacaagcagaagatcatcagaggcttctgccacctgtgcgacggccagttcctgctgcccctgacccaggaggcctgctgcgtgggcctggaggccggcatcaaccccaccgaccacctgatcaccgcctacagagcccacggcttcaccttcaccagaggcctgagcgtgagagagatcctggccgagctgaccggcagaaagggcggctgcgccaagggcaagggcggcagcatgcacatgtacgccaagaacttctacggcggcaacggcatcgtgggcgcccaggtgcccctgggcgccggcatcgccctggcctgcaagtacaacggcaaggacgaggtgtgcctgaccctgtacggcgacggcgccgccaaccagggccagatcttcgaggcctacaacatggccgccctgtggaagctgccctgcatcttcatctgcgagaacaacagatacggcatgggcaccagcgtggagagagccgccgccagcaccgactactacaagagaggcgacttcatccccggcctgagagtggacggcatggacatcctgtgcgtgagagaggccaccagattcgccgccgcctactgcagaagcggcaagggccccatcctgatggagctgcagacctacagataccacggccacagcatgagcgaccccggcgtgagctacagaaccagagaggagatccaggaggtgagaagcaagagcgaccccatcatgctgctgaaggacagaatggtgaacagcaacctggccagcgtggaggagctgaaggagatcgacgtggaggtgagaaaggagatcgaggacgccgcccagttcgccaccgccgaccccgagccccccctggaggagctgggctaccacatctacagcagcgacccccccttcgaggtgagaggcgccaaccagtggatcaagttcaagagcgtgagctag

SEQ ID NO: 95967 - DNA, 1167 bp, Artificial Sequence
  Description of Artificial Sequence: Synthetic coding sequence
atgctggccgccttcatcagcagagtgctgagaagagtggcccagaagagcgccagaagagtgctggtggccagcagaaacagcagcaacgacgccaccttcgagatcaagaagtgcgacctgtacctgctggaggagggcccccccgtgaccaccgtgctgaccagagccgagggcctgaagtactacagaatgatgctgaccgtgagaagaatggagctgaaggccgaccagctgtacaagcagaagttcatcagaggcttctgccacctgtgcgacggccaggaggcctgctgcgtgggcctggaggccggcatcaaccccagcgaccacgtgatcaccagctacagagcccacggcgtgtgctacaccagaggcctgagcgtgagaagcatcctggccgagctgaccggcagaagaggcggctgcgccaagggcaagggcggcagcatgcacatgtacaccaagaacttctacggcggcaacggcatcgtgggcgcccagggccccctgggcgccggcatcgccctggcctgcaagtacaagggcaacgacgagatctgcctgaccctgtacggcgacggcgccgccaaccagggccagatcgccgaggccttcaacatggccgccctgtggaagctgccctgcgtgttcatctgcgagaacaacctgtacggcatgggcaccagcaccgagagagccgccgccagccccgactactacaagagaggcaacttcatccccggcctgaaggtggacggcatggacgtgctgtgcgtgagagaggccaccaagttcgccgccaactactgcagaagcggcaagggccccatcctgatggagctgcagacctacagataccacggccacagcatgagcgaccccggcgtgagctacagaaccagagaggagatccaggaggtgagaagcaagagagaccccatcatcatcctgcaggacagaatggtgaacagcaagctggccaccgtggaggagctgaaggagatcggcgccgaggtgagaaaggagatcgacgacgccgcccagttcgccaccaccgaccccgagccccacctggaggagctgggccaccacatctacagcagcgacagcagcttcgaggtgagaggcgccaacccctggatcaagttcaagagcgtgagctag

SEQ ID NO: 95968 - DNA, 1080 bp, Artificial Sequence
  Description of Artificial Sequence: Synthetic coding sequence
atggccgccgtgagcggcctggtgagaagacccctgagagaggtgagcggcctgctgaagagaagattccactggaccgcccccgccgccctgcaggtgaccgtgagagacgccatcaaccagggcatggacgaggagctggagagagacgagaaggtgttcctgctgggcgaggaggtggcccagtacgacggcgcctacaaggtgagcagaggcctgtggaagaagtacggcgacaagagaatcatcgacacccccatcagcgagatgggcttcgccggcatcgccgtgggcgccgccatggccggcctgagacccatctgcgagttcatgaccttcaacttcagcatgcaggccatcgaccaggtgatcaacagcgccgccaagacctactacatgagcggcggcctgcagcccgtgcccatcgtgttcagaggccccaacggcgccagcgccggcgtggccgcccagcacagccagtgcttcgccgcctggtacggccactgccccggcctgaaggtggtgagcccctggaacagcgaggacgccaagggcctgatcaagagcgccatcagagacaacaaccccgtggtggtgctggagaacgagctgatgtacggcgtgcccttcgagttcccccccgaggcccagagcaaggacttcctgatccccatcggcaaggccaagatcgagagacagggcacccacatcaccgtggtgagccacagcagacccgtgggccactgcctggaggccgccgccgtgctgagcaaggagggcgtggagtgcgaggtgatcaacatgagaaccatcagacccatggacatggagaccatcgaggccagcgtgatgaagaccaaccacctggtgaccgtggagggcggctggccccagttcggcgtgggcgccgagatctgcgccagaatcatggagggccccgccttcaacttcctggacgcccccgccgtgagagtgaccggcgccgacgtgcccatgccctacgccaagatcctggaggacaacagcatcccccaggtgaaggacatcatcttcgccatcaagaagaccctgaacatctag

SEQ ID NO: 95969 - DNA, 1026 bp, Artificial Sequence
  Description of Artificial Sequence: Synthetic coding sequence
atggccgccgtgagcggcctggtgagaagacccctgagagaggtgaccgtgagagacgccatcaaccagggcatggacgaggagctggagagagacgagaaggtgttcctgctgggcgaggaggtggcccagtacgacggcgcctacaaggtgagcagaggcctgtggaagaagtacggcgacaagagaatcatcgacacccccatcagcgagatgggcttcgccggcatcgccgtgggcgccgccatggccggcctgagacccatctgcgagttcatgaccttcaacttcagcatgcaggccatcgaccaggtgatcaacagcgccgccaagacctactacatgagcggcggcctgcagcccgtgcccatcgtgttcagaggccccaacggcgccagcgccggcgtggccgcccagcacagccagtgcttcgccgcctggtacggccactgccccggcctgaaggtggtgagcccctggaacagcgaggacgccaagggcctgatcaagagcgccatcagagacaacaaccccgtggtggtgctggagaacgagctgatgtacggcgtgcccttcgagttcccccccgaggcccagagcaaggacttcctgatccccatcggcaaggccaagatcgagagacagggcacccacatcaccgtggtgagccacagcagacccgtgggccactgcctggaggccgccgccgtgctgagcaaggagggcgtggagtgcgaggtgatcaacatgagaaccatcagacccatggacatggagaccatcgaggccagcgtgatgaagaccaaccacctggtgaccgtggagggcggctggccccagttcggcgtgggcgccgagatctgcgccagaatcatggagggccccgccttcaacttcctggacgcccccgccgtgagagtgaccggcgccgacgtgcccatgccctacgccaagatcctggaggacaacagcatcccccaggtgaaggacatcatcttcgccatcaagaagaccctgaacatctag

SEQ ID NO: 95970 - DNA, 1026 bp, Artificial Sequence
  Description of Artificial Sequence: Synthetic coding sequence
atggccgccgtgagcggcctggtgagaagacccctgagagaggtgagcggcctgctgaagagaagattccactggaccgcccccgccgccctgcaggtgaccgtgagagacgccatcaaccagggcatggacgaggagctggagagagacgagaaggtgttcctgctgggcgaggaggtggcccagtacgacggcgcctacaaggtgagcagaggcctgtggaagaagtacggcgacaagagaatcatcgacacccccatcagcgagatgggcttcgccggcatcgccgtgggcgccgccatggccggcctgagacccatctgcgagttcatgaccttcaacttcagcatgcaggccatcgaccaggtgatcaacagcgccgccaagacctactacatgagcggcgtggccgcccagcacagccagtgcttcgccgcctggtacggccactgccccggcctgaaggtggtgagcccctggaacagcgaggacgccaagggcctgatcaagagcgccatcagagacaacaaccccgtggtggtgctggagaacgagctgatgtacggcgtgcccttcgagttcccccccgaggcccagagcaaggacttcctgatccccatcggcaaggccaagatcgagagacagggcacccacatcaccgtggtgagccacagcagacccgtgggccactgcctggaggccgccgccgtgctgagcaaggagggcgtggagtgcgaggtgatcaacatgagaaccatcagacccatggacatggagaccatcgaggccagcgtgatgaagaccaaccacctggtgaccgtggagggcggctggccccagttcggcgtgggcgccgagatctgcgccagaatcatggagggccccgccttcaacttcctggacgcccccgccgtgagagtgaccggcgccgacgtgcccatgccctacgccaagatcctggaggacaacagcatcccccaggtgaaggacatcatcttcgccatcaagaagaccctgaacatctag

SEQ ID NO: 95971 - DNA, 1236 bp, Artificial Sequence
  Description of Artificial Sequence: Synthetic coding sequence
atgaaggccgccagattcgtgctgagaagcgccggcagcctgaacggcgccggcctggtgcccagagaggtggagcacttcagcagatacagccccagccccctgagcatgaagcagctgctggacttcggcagcgagaacgcctgcgagagaaccagcttcgccttcctgagacaggagctgcccgtgagactggccaacatcctgaaggagatcgacatcctgcccacccagctggtgaacaccagcagcgtgcagctggtgaagagctggtacatccagagcctgatggacctggtggagttccacgagaagagccccgacgaccagaaggccctgagcgacttcgtggacaccctgatcaaggtgagaaacagacaccacaacgtggtgcccaccatggcccagggcatcatcgagtacaaggacgcctgcaccgtggaccccgtgaccaaccagaacctgcagtacttcctggacagattctacatgaacagaatcagcaccagaatgctgatgaaccagcacatcctgatcttcagcgacagccagaccggcaaccccagccacatcggcagcatcgaccccaactgcgacgtggtggccgtggtgcaggacgccttcgagtgcagcagaatgctgtgcgaccagtactacctgagcagccccgagctgaagctgacccaggtgaacggcaagttccccgaccagcccatccacatcgtgtacgtgcccagccacctgcaccacatgctgttcgagctgttcaagaacgccatgagagccaccgtggagcaccaggagaaccagcccagcctgacccccatcgaggtgatcgtggtgctgggcaaggaggacctgaccatcaagatcagcgacagaggcggcggcgtgcccctgagaatcatcgacagactgttcagctacacctacagcaccgcccccacccccgtgatggacaacagcagaaacgcccccctggccggcttcggctacggcctgcccatcagcagactgtacgccaagtacttccagggcgacctgaacctgtacagcctgagcggctacggcaccgacgccatcatctacctgaaggccctgagcagcgagagcatcgagaagctgcccgtgttcaacaagagcgccttcaagcactaccagatgagcagcgaggccgacgactggtgcatccccagcagagagcccaagaacctggccaaggaggtggccatgtag

SEQ ID NO: 95972 - DNA, 1128 bp, Artificial Sequence
  Description of Artificial Sequence: Synthetic coding sequence
atgaagcagctgctggacttcggcagcgagaacgcctgcgagagaaccagcttcgccttcctgagacaggagctgcccgtgagactggccaacatcctgaaggagatcgacatcctgcccacccagctggtgaacaccagcagcgtgcagctggtgaagagctggtacatccagagcctgatggacctggtggagttccacgagaagagccccgacgaccagaaggccctgagcgacttcgtggacaccctgatcaaggtgagaaacagacaccacaacgtggtgcccaccatggcccagggcatcatcgagtacaaggacgcctgcaccgtggaccccgtgaccaaccagaacctgcagtacttcctggacagattctacatgaacagaatcagcaccagaatgctgatgaaccagcacatcctgatcttcagcgacagccagaccggcaaccccagccacatcggcagcatcgaccccaactgcgacgtggtggccgtggtgcaggacgccttcgagtgcagcagaatgctgtgcgaccagtactacctgagcagccccgagctgaagctgacccaggtgaacggcaagttccccgaccagcccatccacatcgtgtacgtgcccagccacctgcaccacatgctgttcgagctgttcaagaacgccatgagagccaccgtggagcaccaggagaaccagcccagcctgacccccatcgaggtgatcgtggtgctgggcaaggaggacctgaccatcaagatcagcgacagaggcggcggcgtgcccctgagaatcatcgacagactgttcagctacacctacagcaccgcccccacccccgtgatggacaacagcagaaacgcccccctggccggcttcggctacggcctgcccatcagcagactgtacgccaagtacttccagggcgacctgaacctgtacagcctgagcggctacggcaccgacgccatcatctacctgaaggccctgagcagcgagagcatcgagaagctgcccgtgttcaacaagagcgccttcaagcactaccagatgagcagcgaggccgacgactggtgcatccccagcagagagcccaagaacctggccaaggaggtggccatgtag

SEQ ID NO: 95973 - DNA, 1614 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagaagttctacctgacccccccccaggtgaacagcatcctgaaggccaacgagtacagcttcaaggtgcccgagttcgacggcaagaacgtgagcagcatcctgggcttcgacagcaaccagctgcccgccaacgcccccatcgaggacagaagaagcgccgccacctgcctgcagaccagaggcatgctgctgggcgtgttcgacggccacgccggctgcgcctgcagccaggccgtgagcgagagactgttctactacatcgccgtgagcctgctgccccacgagaccctgctggagatcgagaacgccgtggagagcggcagagccctgctgcccatcctgcagtggcacaagcaccccaacgactacttcagcaaggaggccagcaagctgtacttcaacagcctgagaacctactggcaggagctgatcgacctgaacaccggcgagagcaccgacatcgacgtgaaggaggccctgatcaacgccttcaagagactggacaacgacatcagcctggaggcccaggtgggcgaccccaacagcttcctgaactacctggtgctgagagtggccttcagcggcgccaccgcctgcgtggcccacgtggacggcgtggacctgcacgtggccaacaccggcgacagcagagccatgctgggcgtgcaggaggaggacggcagctggagcgccgtgaccctgagcaacgaccacaacgcccagaacgagagagagctggagagactgaagctggagcaccccaagagcgaggccaagagcgtggtgaagcaggacagactgctgggcctgctgatgcccttcagagccttcggcgacgtgaagttcaagtggagcatcgacctgcagaagagagtgatcgagagcggccccgaccagctgaacgacaacgagtacaccaagttcatcccccccaactaccacacccccccctacctgaccgccgagcccgaggtgacctaccacagactgagaccccaggacaagttcctggtgctggccaccgacggcctgtgggagaccatgcacagacaggacgtggtgagaatcgtgggcgagtacctgaccggcatgcaccaccagcagcccatcgccgtgggcggctacaaggtgaccctgggccagatgcacggcctgctgaccgagagaagaaccaagatgagcagcgtgttcgaggaccagaacgccgccacccacctgatcagacacgccgtgggcaacaacgagttcggcaccgtggaccacgagagactgagcaagatgctgagcctgcccgaggagctggccagaatgtacagagacgacatcaccatcatcgtggtgcagttcaacagccacgtggtgggcgcctaccagaaccaggagtag

SEQ ID NO: 95974 - DNA, 1689 bp, Artificial Sequence
  Description of Artificial Sequence: Synthetic coding sequence
atgtgcgtgtgccccggccccagaagaatcggcatccccgtgagaagcagcagcctgcccctgttcagcgacgccatgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagaagttctacctgacccccccccaggtgaacagcatcctgaaggccaacgagtacagcttcaaggtgcccgagttcgacggcaagaacgtgagcagcatcctgggcttcgacagcaaccagctgcccgccaacgcccccatcgaggacagaagaagcgccgccacctgcctgcagaccagaggcatgctgctgggcgtgttcgacggccacgccggctgcgcctgcagccaggccgtgagcgagagactgttctactacatcgccgtgagcctgctgccccacgagaccctgctggagatcgagaacgccgtggagagcggcagagccctgctgcccatcctgcagtggcacaagcaccccaacgactacttcagcaaggaggccagcaagctgtacttcaacagcctgagaacctactggcaggagctgatcgacctgaacaccggcgagagcaccgacatcgacgtgaaggaggccctgatcaacgccttcaagagactggacaacgacatcagcctggaggcccaggtgggcgaccccaacagcttcctgaactacctggtgctgagagtggccttcagcggcgccaccgcctgcgtggcccacgtggacggcgtggacctgcacgtggccaacaccggcgacagcagagccatgctgggcgtgcaggaggaggacggcagctggagcgccgtgaccctgagcaacgaccacaacgcccagaacgagagagagctggagagactgaagctggagcaccccaagagcgaggccaagagcgtggtgaagcaggacagactgctgggcctgctgatgcccttcagagccttcggcgacgtgaagttcaagtggagcatcgacctgcagaagagagtgatcgagagcggccccgaccagctgaacgacaacgagtacaccaagttcatcccccccaactaccacacccccccctacctgaccgccgagcccgaggtgacctaccacagactgagaccccaggacaagttcctggtgctggccaccgacggcctgtgggagaccatgcacagacaggacgtggtgagaatcgtgggcgagtacctgaccggcatgcaccaccagcagcccatcgccgtgggcggctacaaggtgaccctgggccagatgcacggcctgctgaccgagagaagaaccaagatgagcagcgtgttcgaggaccagaacgccgccacccacctgatcagacacgccgtgggcaacaacgagttcggcaccgtggaccacgagagactgagcaagatgctgagcctgcccgaggagctggccagaatgtacagagacgacatcaccatcatcgtggtgcagttcaacagccacgtggtgggcgcctaccagaaccaggagtag

SEQ ID NO: 95975 - DNA, 1614 bp, Artificial Sequence; identical to SEQ ID NO: 95973
  Description of Artificial Sequence: Synthetic coding sequence

SEQ ID NO: 95976 - DNA, 231 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagtag

SEQ ID NO: 95977 - DNA, 387 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagaagttctacctgacccccccccaggtgaacagcatcctgaaggccaacgagtacagcttcaaggtgcccgagttcgacggcaagaacgtgagcagcatcctgggcttcgacagcaaccagctgcccgccaacgcccccatcgaggacagaagaagctag

SEQ ID NO: 95978 - DNA, 699 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagaagttctacctgacccccccccaggtgaacagcatcctgaaggccaacgagtacagcttcaaggtgcccgagttcgacggcaagaacgtgagcagcatcctgggcttcgacagcaaccagctgcccgccaacgcccccatcgaggacagaagaagcgccgccacctgcctgcagaccagaggcatgctgctgggcgtgttcgacggccacgccggctgcgcctgcagccaggccgtgagcgagagactgttctactacatcgccgtgagcctgctgccccacgagaccctgctggagatcgagaacgccgtggagagcggcagagccctgctgcccatcctgcagtggcacaagcaccccaacgactacttcagcaaggaggccagcaagctgtacttcaacagcctgagaacctactggcaggagctgatcgacctgaacaccggcgagagcaccgacatcgacgtgtag

SEQ ID NO: 95979 - DNA, 219 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgcctag

SEQ ID NO: 95980 - DNA, 1614 bp, Artificial Sequence; identical to SEQ ID NO: 95973
  Description of Artificial Sequence: Synthetic coding sequence

SEQ ID NO: 95981 - DNA, 444 bp, Artificial Sequence
  Description of Artificial Sequence: Synthetic coding sequence
atgcccgcccccacccagctgttcttccccctgatcagaaactgcgagctgagcagaatctacggcaccgcctgctactgccaccacaagcacctgtgctgcagcagcagctacatcccccagagcagactgagatacaccccccaccccgcctacgccaccttctgcagacccaaggagaactggtggcagtacacccagggcagaagatacgccagcaccccccagaagttctacctgacccccccccaggtgaacagcatcctgaaggccaacgagtacagcttcaaggtgcccgagttcgacggcaagaacgtgagcagcatcctgggcttcgacagcaaccagctgcccgccaacgcccccatcgaggacagaagaagcgccgccacctgcctgcagaccagaggcatgctgctgggcgtgttcgacggccacgcctag

SEQ ID NO: 95982 - DNA, 1467 bp, Artificial Sequence
  Description of Artificial Sequence: Synthetic coding sequence
atggccgacaccttcctggagcacctgtgcctgctggacatcgacagcgagcccgtggccgccagaagcaccagcatcatcgccaccatcggccccgccagcagaagcgtggagagactgaaggagatgatcaaggccggcatgaacatcgccagactgaacttcagccacggcagccacgagtaccacgccgagagcatcgccctggacaccaagggccccgagatcagaaccggcatcctgcagggcggccccgagagcgaggtggagctggtgaagggcagccaggtgctggtgaccgtggaccccgccttcagaaccagaggcaacgccaacaccgtgtgggtggactaccccaacatcgtgagagtggtgcccgtgggcggcagaatctacatcgacgacggcctgatcagcctggtggtgcagaagatcggccccgagggcctggtgacccaggtggagaacggcggcgtgctgggcagcagaaagggcgtgaacctgcccggcgcccaggtggacctgcccggcctgagcgagcaggacgtgagagacctgagattcggcgtggagcacggcgtggacatcgtgttcgccagcttcgtgagaaaggccagcgacgtggccgccgtgagagccgccctgggccccgagggccacggcatcaagatcatcagcaagatcgagaaccacgagggcgtgaagagattcgacgagatcctggaggtgagcgacggcatcatggtggccagaggcgacctgggcatcgagatccccgccgagaaggtgttcctggcccagaagatgatgatcggcagatgcaacctggccggcaagcccgtggtgtgcgccacccagatgctggagagcatgatcaccaagcccagacccaccagagccgagaccagcgacgtggccaacgccgtgctggacggcgccgactgcatcatgctgagcggcgagaccgccaagggcaacttccccgtggaggccgtgaagatgcagcacgccatcgccagagaggccgaggccgccgtgtaccacagacagctgttcgaggagctgagaagagccgcccccctgagcagagaccccaccgaggtgaccgccatcggcgccgtggaggccgccttcaagtgctgcgccgccgccatcatcgtgctgaccaccaccggcagaagcgcccagctgctgagcagatacagacccagagccgccgtgatcgccgtgaccagaagcgcccaggccgccagacaggtgcacctgtgcagaggcgtgttccccctgctgtacagagagccccccgaggccatctgggccgacgacgtggacagaagagtgcagttcggcatcgagagcggcaagctgagaggcttcctgagagtgggcgacctggtgatcgtggtgaccggctggagacccggcagcggctacaccaacatcatgagagtgctgagcatcagctag

SEQ ID NO: 95983 - DNA, 1725 bp, Artificial Sequence
  Description of Artificial Sequence: Synthetic coding sequence
atgagcatccaggagaacatcagcagcctgcagctgagaagctgggtgagcaagagccagagagacctggccaagagcatcctgatcggcgcccccggcggccccgccggctacctgagaagagccagcgtggcccagctgacccaggagctgggcaccgccttcttccagcagcagcagctgcccgccgccatggccgacaccttcctggagcacctgtgcctgctggacatcgacagcgagcccgtggccgccagaagcaccagcatcatcgccaccatcggccccgccagcagaagcgtggagagactgaaggagatgatcaaggccggcatgaacatcgccagactgaacttcagccacggcagccacgagtaccacgccgagagcatcgccaacgtgagagaggccgtggagagcttcgccggcagccccctgagctacagacccgtggccatcgccctggacaccaagggccccgagatcagaaccggcatcctgcagggcggccccgagagcgaggtggagctggtgaagggcagccaggtgctggtgaccgtggaccccgccttcagaaccagaggcaacgccaacaccgtgtgggtggactaccccaacatcgtgagagtggtgcccgtgggcggcagaatctacatcgacgacggcctgatcagcctggtggtgcagaagatcggccccgagggcctggtgacccaggtggagaacggcggcgtgctgggcagcagaaagggcgtgaacctgcccggcgcccaggtggacctgcccggcctgagcgagcaggacgtgagagacctgagattcggcgtggagcacggcgtggacatcgtgttcgccagcttcgtgagaaaggccagcgacgtggccgccgtgagagccgccctgggccccgagggccacggcatcaagatcatcagcaagatcgagaaccacgagggcgtgaagagattcgacgagatcctggaggtgagcgacggcatcatggtggccagaggcgacctgggcatcgagatccccgccgagaaggtgttcctggcccagaagatgatgatcggcagatgcaacctggccggcaagcccgtggtgtgcgccacccagatgctggagagcatgatcaccaagcccagacccaccagagccgagaccagcgacgtggccaacgccgtgctggacggcgccgactgcatcatgctgagcggcgagaccgccaagggcaacttccccgtggaggccgtgaagatgcagcacgccatcgccagagaggccgaggccgccgtgtaccacagacagctgttcgaggagctgagaagagccgcccccctgagcagagaccccaccgaggtgaccgccatcggcgccgtggaggccgccttcaagtgctgcgccgccgccatcatcgtgctgaccaccaccggcagaagcgcccagctgctgagcagatacagacccagagccgccgtgatcgccgtgaccagaagcgcccaggccgccagacaggtgcacctgtgcagaggcgtgttccccctgctgtacagagagccccccgaggccatctgggccgacgacgtggacagaagagtgcagttcggcatcgagagcggcaagctgagaggcttcctgagagtgggcgacctggtgatcgtggtgaccggctggagacccggcagcggctacaccaacatcatgagagtgctgagcatcagctag

SEQ ID NO: 95984 - DNA, 1632 bp, Artificial Sequence
  Description of Artificial Sequence: Synthetic coding sequence
atggagggccccgccggctacctgagaagagccagcgtggcccagctgacccaggagctgggcaccgccttcttccagcagcagcagctgcccgccgccatggccgacaccttcctggagcacctgtgcctgctggacatcgacagcgagcccgtggccgccagaagcaccagcatcatcgccaccatcggccccgccagcagaagcgtggagagactgaaggagatgatcaaggccggcatgaacatcgccagactgaacttcagccacggcagccacgagtaccacgccgagagcatcgccaacgtgagagaggccgtggagagcttcgccggcagccccctgagctacagacccgtggccatcgccctggacaccaagggccccgagatcagaaccggcatcctgcagggcggccccgagagcgaggtggagctggtgaagggcagccaggtgctggtgaccgtggaccccgccttcagaaccagaggcaacgccaacaccgtgtgggtggactaccccaacatcgtgagagtggtgcccgtgggcggcagaatctacatcgacgacggcctgatcagcctggtggtgcagaagatcggccccgagggcctggtgacccaggtggagaacggcggcgtgctgggcagcagaaagggcgtgaacctgcccggcgcccaggtggacctgcccggcctgagcgagcaggacgtgagagacctgagattcggcgtggagcacggcgtggacatcgtgttcgccagcttcgtgagaaaggccagcgacgtggccgccgtgagagccgccctgggccccgagggccacggcatcaagatcatcagcaagatcgagaaccacgagggcgtgaagagattcgacgagatcctggaggtgagcgacggcatcatggtggccagaggcgacctgggcatcgagatccccgccgagaaggtgttcctggcccagaagatgatgatcggcagatgcaacctggccggcaagcccgtggtgtgcgccacccagatgctggagagcatgatcaccaagcccagacccaccagagccgagaccagcgacgtggccaacgccgtgctggacggcgccgactgcatcatgctgagcggcgagaccgccaagggcaacttccccgtggaggccgtgaagatgcagcacgccatcgccagagaggccgaggccgccgtgtaccacagacagctgttcgaggagctgagaagagccgcccccctgagcagagaccccaccgaggtgaccgccatcggcgccgtggaggccgccttcaagtgctgcgccgccgccatcatcgtgctgaccaccaccggcagaagcgcccagctgctgagcagatacagacccagagccgccgtgatcgccgtgaccagaagcgcccaggccgccagacaggtgcacctgtgcagaggcgtgttccccctgctgtacagagagccccccgaggccatctgggccgacgacgtggacagaagagtgcagttcggcatcgagagcggcaagctgagaggcttcctgagagtgggcgacctggtgatcgtggtgaccggctggagacccggcagcggctacaccaacatcatgagagtgctgagcatcagctag

SEQ ID NO: 95985 - DNA, 1800 bp, Artificial Sequence
  Description of Artificial Sequence: Synthetic coding sequence
atgagcatccaggagaacatcagcagcctgcagctgagaagctgggtgagcaagagccagagagacctggccaagagcatcctgatcggcgcccccggcgtgcccctgaccacccagcagtgcggcgccgacccccagagaggcagacccagagaggtgtgcagcggcatggagggccccgccggctacctgagaagagccagcgtggcccagctgacccaggagctgggcaccgccttcttccagcagcagcagctgcccgccgccatggccgacaccttcctggagcacctgtgcctgctggacatcgacagcgagcccgtggccgccagaagcaccagcatcatcgccaccatcggccccgccagcagaagcgtggagagactgaaggagatgatcaaggccggcatgaacatcgccagactgaacttcagccacggcagccacgagtaccacgccgagagcatcgccaacgtgagagaggccgtggagagcttcgccggcagccccctgagctacagacccgtggccatcgccctggacaccaagggccccgagatcagaaccggcatcctgcagggcggccccgagagcgaggtggagctggtgaagggcagccaggtgctggtgaccgtggaccccgccttcagaaccagaggcaacgccaacaccgtgtgggtggactaccccaacatcgtgagagtggtgcccgtgggcggcagaatctacatcgacgacggcctgatcagcctggtggtgcagaagatcggccccgagggcctggtgacccaggtggagaacggcggcgtgctgggcagcagaaagggcgtgaacctgcccggcgcccaggtggacctgcccggcctgagcgagcaggacgtgagagacctgagattcggcgtggagcacggcgtggacatcgtgttcgccagcttcgtgagaaaggccagcgacgtggccgccgtgagagccgccctgggccccgagggccacggcatcaagatcatcagcaagatcgagaaccacgagggcgtgaagagattcgacgagatcctggaggtgagcgacggcatcatggtggccagaggcgacctgggcatcgagatccccgccgagaaggtgttcctggcccagaagatgatgatcggcagatgcaacctggccggcaagcccgtggtgtgcgccacccagatgctggagagcatgatcaccaagcccagacccaccagagccgagaccagcgacgtggccaacgccgtgctggacggcgccgactgcatcatgctgagcggcgagaccgccaagggcaacttccccgtggaggccgtgaagatgcagcacgccatcgccagagaggccgaggccgccgtgtaccacagacagctgttcgaggagctgagaagagccgcccccctgagcagagaccccaccgaggtgaccgccatcggcgccgtggaggccgccttcaagtgctgcgccgccgccatcatcgtgctgaccaccaccggcagaagcgcccagctgctgagcagatacagacccagagccgccgtgatcgccgtgaccagaagcgcccaggccgccagacaggtgcacctgtgcagaggcgtgttccccctgctgtacagagagccccccgaggccatctgggccgacgacgtggacagaagagtgcagttcggcatcgagagcggcaagctgagaggcttcctgagagtgggcgacctggtgatcgtggtgaccggctggagacccggcagcggctacaccaacatcatgagagtgctgagcatcagctag

SEQ ID NO: 95986 - DNA, 1596 bp, Artificial Sequence
  Description of Artificial Sequence: Synthetic coding sequence
atgagcaagccccacagcgaggccggcaccgccttcatccagacccagcagctgcacgccgccatggccgacaccttcctggagcacatgtgcagactggacatcgacagcccccccatcaccgccagaaacaccggcatcatctgcaccatcggccccgccagcagaagcgtggagaccctgaaggagatgatcaagagcggcatgaacgtggccagactgaacttcagccacggcacccacgagtaccacgccgagaccatcaagaacgtgagaaccgccaccgagagcttcgccagcgaccccatcctgtacagacccgtggccgtggccctggacaccaagggccccgagatcagaaccggcctgatcaagggcagcggcaccgccgaggtggagctgaagaagggcgccaccctgaagatcaccctggacaacgcctacatggagaagtgcgacgagaacatcctgtggctggactacaagaacatctgcaaggtggtggaggtgggcagcaagatctacgtggacgacggcctgatcagcctgcaggtgaagcagaagggcgccgacttcctggtgaccgaggtggagaacggcggcagcctgggcagcaagaagggcgtgaacctgcccggcgccgccgtggacctgcccgccgtgagcgagaaggacatccaggacctgaagttcggcgtggagcaggacgtggacatggtgttcgccagcttcatcagaaaggccagcgacgtgcacgaggtgagaaaggtgctgggcgagaagggcaagaacatcaagatcatcagcaagatcgagaaccacgagggcgtgagaagattcgacgagatcctggaggccagcgacggcatcatggtggccagaggcgacctgggcatcgagatccccgccgagaaggtgttcctggcccagaagatgatgatcggcagatgcaacagagccggcaagcccgtgatctgcgccacccagatgctggagagcatgatcaagaagcccagacccaccagagccgagggcagcgacgtggccaacgccgtgctggacggcgccgactgcatcatgctgagcggcgagaccgccaagggcgactaccccctggaggccgtgagaatgcagcacctgatcgccagagaggccgaggccgccatgttccacagaaagctgttcgaggagctggtgagagccagcagccacagcaccgacctgatggaggccatggccatgggcagcgtggaggccagctacaagtgcctggccgccgccctgatcgtgctgaccgagagcggcagaagcgcccaccaggtggccagatacagacccagagcccccatcatcgccgtgaccagaaacccccagaccgccagacaggcccacctgtacagaggcatcttccccgtgctgtgcaaggaccccgtgcaggaggcctgggccgaggacgtggacctgagagtgaacttcgccatgaacgtgggcaaggccagaggcttcttcaagaagggcgacgtggtgatcgtgctgaccggctggagacccggcagcggcttcaccaacaccatgagagtggtgcccgtgccctag

SEQ ID NO: 95987 - DNA, 1101 bp, Artificial Sequence
  Description of Artificial Sequence: Synthetic coding sequence
atgagcaagccccacagcgaggccggcaccgccttcatccagacccagcagctgcacgccgccatggccgacaccttcctggagcacatgtgcagactggacatcgacagcccccccatcaagaagggcgtgaacctgcccggcgccgccgtggacctgcccgccgtgagcgagaaggacatccaggacctgaagttcggcgtggagcaggacgtggacatggtgttcgccagcttcatcagaaaggccagcgacgtgcacgaggtgagaaaggtgctgggcgagaagggcaagaacatcaagatcatcagcaagatcgagaaccacgagggcgtgagaagattcgacgagatcctggaggccagcgacggcatcatggtggccagaggcgacctgggcatcgagatccccgccgagaaggtgttcctggcccagaagatgatgatcggcagatgcaacagagccggcaagcccgtgatctgcgccacccagatgctggagagcatgatcaagaagcccagacccaccagagccgagggcagcgacgtggccaacgccgtgctggacggcgccgactgcatcatgctgagcggcgagaccgccaagggcgactaccccctggaggccgtgagaatgcagcacctgatcgccagagaggccgaggccgccatgttccacagaaagctgttcgaggagctggtgagagccagcagccacagcaccgacctgatggaggccatggccatgggcagcgtggaggccagctacaagtgcctggccgccgccctgatcgtgctgaccgagagcggcagaagcgcccaccaggtggccagatacagacccagagcccccatcatcgccgtgaccagaaacccccagaccgccagacaggcccacctgtacagaggcatcttccccgtgctgtgcaaggaccccgtgcaggaggcctgggccgaggacgtggacctgagagtgaacttcgccatgaacgtgggcaaggccagaggcttcttcaagaagggcgacgtggtgatcgtgctgaccggctggagacccggcagcggcttcaccaacaccatgagagtggtgcccgtgccctag

SEQ ID NO: 95988 - DNA, 1596 bp, Artificial Sequence
  Description of Artificial Sequence: Synthetic coding sequence
atgagcaagccccacagcgaggccggcaccgccttcatccagacccagcagctgcacgccgccatggccgacaccttcctggagcacatgtgcagactggacatcgacagcccccccatcaccgccagaaacaccggcatcatctgcaccatcggccccgccagcagaagcgtggagaccctgaaggagatgatcaagagcggcatgaacgtggccagactgaacttcagccacggcacccacgagtaccacgccgagaccatcaagaacgtgagaaccgccaccgagagcttcgccagcgaccccatcctgtacagacccgtggccgtggccctggacaccaagggccccgagatcagaaccggcctgatcaagggcagcggcaccgccgaggtggagctgaagaagggcgccaccctgaagatcaccctggacaacgcctacatggagaagtgcgacgagaacatcctgtggctggactacaagaacatctgcaaggtggtggaggtgggcagcaagatctacgtggacgacggcctgatcagcctgcaggtgaagcagaagggcgccgacttcctggtgaccgaggtggagaacggcggcagcctgggcagcaagaagggcgtgaacctgcccggcgccgccgtggacctgcccgccgtgagcgagaaggacatccaggacctgaagttcggcgtggagcaggacgtggacatggtgttcgccagcttcatcagaaaggccagcgacgtgcacgaggtgagaaaggtgctgggcgagaagggcaagaacatcaagatcatcagcaagatcgagaaccacgagggcgtgagaagattcgacgagatcctggaggccagcgacggcatcatggtggccagaggcgacctgggcatcgagatccccgccgagaaggtgttcctggcccagaagatgatgatcggcagatgcaacagagccggcaagcccgtgatctgcgccacccagatgctggagagcatgatcaagaagcccagacccaccagagccgagggcagcgacgtggccaacgccgtgctggacggcgccgactgcatcatgctgagcggcgagaccgccaagggcgactaccccctggaggccgtgagaatgcagcacctgatcgccagagaggccgaggccgccatctaccacctgcagctgttcgaggagctgagaagactggcccccatcaccagcgaccccaccgaggccaccgccgtgggcgccgtggaggccagcttcaagtgctgcagcggcgccatcatcgtgctgaccaagagcggcagaagcgcccaccaggtggccagatacagacccagagcccccatcatcgccgtgaccagaaacccccagaccgccagacaggcccacctgtacagaggcatcttccccgtgctgtgcaaggaccccgtgcaggaggcctgggccgaggacgtggacctgagagtgaacttcgccatgaacgtgggcaaggccagaggcttcttcaagaagggcgacgtggtgatcgtgctgaccggctggagacccggcagcggcttcaccaacaccatgagagtggtgcccgtgccctag

SEQ ID NO: 95989 - DNA, 1596 bp, Artificial Sequence; identical to SEQ ID NO: 95986
  Description of Artificial Sequence: Synthetic coding sequence

SEQ ID NO: 95990 - DNA, 1377 bp, Artificial Sequence
  Description of Artificial Sequence: Synthetic coding sequence
atgagcaagccccacagcgaggccggcaccgccttcatccagacccagcagctgcacgccgccatggccgacaccttcctggagcacatgtgcagactggacatcgacagcccccccatcaccgccagaaacaccggcatcatctgcaccatcggccccgccagcagaagcgaggtggagctgaagaagggcgccaccctgaagatcaccctggacaacgcctacatggagaagtgcgacgagaacatcctgtggctggactacaagaacatctgcaaggtggtggaggtgggcagcaagatctacgtggacgacggcctgatcagcctgcaggtgaagcagaagggcgccgacttcctggtgaccgaggtggagaacggcggcagcctgggcagcaagaagggcgtgaacctgcccggcgccgccgtggacctgcccgccgtgagcgagaaggacatccaggacctgaagttcggcgtggagcaggacgtggacatggtgttcgccagcttcatcagaaaggccagcgacgtgcacgaggtgagaaaggtgctgggcgagaagggcaagaacatcaagatcatcagcaagatcgagaaccacgagggcgtgagaagattcgacgagatcctggaggccagcgacggcatcatggtggccagaggcgacctgggcatcgagatccccgccgagaaggtgttcctggcccagaagatgatgatcggcagatgcaacagagccggcaagcccgtgatctgcgccacccagatgctggagagcatgatcaagaagcccagacccaccagagccgagggcagcgacgtggccaacgccgtgctggacggcgccgactgcatcatgctgagcggcgagaccgccaagggcgactaccccctggaggccgtgagaatgcagcacctgatcgccagagaggccgaggccgccatctaccacctgcagctgttcgaggagctgagaagactggcccccatcaccagcgaccccaccgaggccaccgccgtgggcgccgtggaggccagcttcaagtgctgcagcggcgccatcatcgtgctgaccaagagcggcagaagcgcccaccaggtggccagatacagacccagagcccccatcatcgccgtgaccagaaacccccagaccgccagacaggcccacctgtacagaggcatcttccccgtgctgtgcaaggaccccgtgcaggaggcctgggccgaggacgtggacctgagagtgaacttcgccatgaacgtgggcaaggccagaggcttcttcaagaagggcgacgtggtgatcgtgctgaccggctggagacccggcagcggcttcaccaacaccatgagagtggtgcccgtgccctag

SEQ ID NO: 95991 - DNA, 1551 bp, Artificial Sequence
  Description of Artificial Sequence: Synthetic coding sequence
atgagccccgaggcccagccccagagaaccaagggcccccagcagccctgcagaagccccatcgtgaagcccggcctgcccagcttcagacccagcagctgcacccagccctggctgacccacagctggagcacctgcgccgcctggaccctgatccaccaccccagccagcccggcaccctggccagcagcgtgcccctgtaccacgccgagaccatcaagaacgtgagaaccgccaccgagagcttcgccagcgaccccatcctgtacagacccgtggccgtggccctggacaccaagggccccgagatcagaaccggcctgatcaagggcagcggcaccgccgaggtggagctgaagaagggcgccaccctgaagatcaccctggacaacgcctacatggagaagtgcgacgagaacatcctgtggctggactacaagaacatctgcaaggtggtggaggtgggcagcaagatctacgtggacgacggcctgatcagcctgcaggtgaagcagaagggcgccgacttcctggtgaccgaggtggagaacggcggcagcctgggcagcaagaagggcgtgaacctgcccggcgccgccgtggacctgcccgccgtgagcgagaaggacatccaggacctgaagttcggcgtggagcaggacgtggacatggtgttcgccagcttcatcagaaaggccagcgacgtgcacgaggtgagaaaggtgctgggcgagaagggcaagaacatcaagatcatcagcaagatcgagaaccacgagggcgtgagaagattcgacgagatcctggaggccagcgacggcatcatggtggccagaggcgacctgggcatcgagatccccgccgagaaggtgttcctggcccagaagatgatgatcggcagatgcaacagagccggcaagcccgtgatctgcgccacccagatgctggagagcatgatcaagaagcccagacccaccagagccgagggcagcgacgtggccaacgccgtgctggacggcgccgactgcatcatgctgagcggcgagaccgccaagggcgactaccccctggaggccgtgagaatgcagcacctgatcgccagagaggccgaggccgccatctaccacctgcagctgttcgaggagctgagaagactggcccccatcaccagcgaccccaccgaggccaccgccgtgggcgccgtggaggccagcttcaagtgctgcagcggcgccatcatcgtgctgaccaagagcggcagaagcgcccaccaggtggccagatacagacccagagcccccatcatcgccgtgaccagaaacccccagaccgccagacaggcccacctgtacagaggcatcttccccgtgctgtgcaaggaccccgtgcaggaggcctgggccgaggacgtggacctgagagtgaacttcgccatgaacgtgggcaaggccagaggcttcttcaagaagggcgacgtggtgatcgtgctgaccggctggagacccggcagcggcttcaccaacaccatgagagtggtgcccgtgccctag

SEQ ID NO: 95992 - DNA, 1212 bp, Artificial Sequence
  Description of Artificial Sequence: Synthetic coding sequence
atggccggcgccgccacccaggccagcctggagagcgcccccagaatcatgagactggtggccgagtgcagcagaagcagagccagagccggcgagctgtggctgccccacggcaccgtggccacccccgtgttcatgcccgtgggcacccaggccaccatgaagggcatcaccaccgagcagctggacgccctgggctgcagaatctgcctgggcaacacctaccacctgggcctgagacccggccccgagctgatccagaaggccaacggcctgcacggcttcatgaactggccccacaacctgctgaccgacagcggcggcttccagatggtgagcctggtgagcctgagcgaggtgaccgaggagggcgtgagattcagaagcccctacgacggcaacgagaccctgctgagccccgagaagagcgtgcagatccagaacgccctgggcagcgacatcatcatgcagctggacgacgtggtgagcagcaccgtgaccggccccagagtggaggaggccatgtacagaagcatcagatggctggacagatgcatcgccgcccaccagagacccgacaagcagaacctgttcgccatcatccagggcggcctggacgccgacctgagagccacctgcctggaggagatgaccaagagagacgtgcccggcttcgccatcggcggcctgagcggcggcgagagcaagagccagttctggagaatggtggccctgagcaccagcagactgcccaaggacaagcccagatacctgatgggcgtgggctacgccaccgacctggtggtgtgcgtggccctgggctgcgacatgttcgactgcgtgttccccaccagaaccgccagattcggcagcgccctggtgcccaccggcaacctgcagctgagaaagaaggtgttcgagaaggacttcggccccatcgaccccgagtgcacctgccccacctgccagaagcacagcagagccttcctgcacgccctgctgcacagcgacaacaccgccgccctgcaccacctgaccgtgcacaacatcgcctaccagctgcagctgatgagcgccgtgagaaccagcatcgtggagaagagattccccgacttcgtgagagacttcatgggcgccatgtacggcgaccccaccctgtgccccacctgggccaccgacgccctggccagcgtgggcatcaccctgggctag

SEQ ID NO: 95993 - DNA, 678 bp, Artificial Sequence
  Description of Artificial Sequence: Synthetic coding sequence
atggccggcgccgccacccaggccagcctggagagcgcccccagaatcatgagactggtggccgagtgcagcagaagcagagccagagccggcgagctgtggctgccccacggcaccgtggccacccccgtgttcatgcccgtgggcacccaggccaccatgaagggcatcaccaccgagcagctggacgccctgggctgcagaatctgcctgggcaacacctaccacctgggcctgagacccggccccgagctgatccagaaggccaacggcctgcacggcttcatgaactggccccacaacctgctgaccgacagcggcggcttccagatggtgagcctggtgagcctgagcgaggtgaccgaggagggcgtgagattcagaagcccctacgacggcaacgagaccctgctgagccccgagaagagcgtgcagatccagaacgccctgggcagcgacatcatcatgcagctggacgacgtggtgagcagcaccgtgaccggccccagagtggaggaggccatgtacagacccctgggcctggtgaccggcgccctgctgcaggtgaaccccctggccggccccgtgcactgcagccccagcgccgccggccaggccgagcccctgagacactaccccggctgggccggcagaagaagccccggccacctgccctag

SEQ ID NO: 95994 - DNA, 2097 bp, Artificial Sequence
  Description of Artificial Sequence: Synthetic coding sequence
atggccgccgccggcgccgccgtggccagaagccccggcatcggcgccggccccgccctgagagccagaagaagccccccccccagagccgccagactgcccagactgctggtgctgctggccgccgccgccgtgggccccggcgccggcggcgccgccagactgtacagagccggcgaggacgccgtgtgggtgctggacagcggcagcgtgagaggcgccaccgccaacagcagcgccgcctggctggtgcagttctacagcagctggtgcggccactgcatcggctacgcccccacctggagagccctggccggcgacgtgagagactgggccagcgccatcagagtggccgccctggactgcatggaggagaagaaccaggccgtgtgccacgactacgacatccacttctaccccaccttcagatacttcaaggccttcaccaaggagttcaccaccggcgagaacttcaagggccccgacagagagctgagaaccgtgagacagaccatgatcgacttcctgcagaaccacaccgagggcagcagaccccccgcctgccccagactggaccccatccagcccagcgacgtgctgagcctgctggacaacagaggcagccactacgtggccatcgtgttcgagagcaacagcagctacctgggcagagaggtgatcctggacctgatcccctacgagagcatcgtggtgaccagagccctggacggcgacaaggccttcctggagaagctgggcgtgagcagcgtgcccagctgctacctgatctaccccaacggcagccacggcctgatcaacgtggtgaagcccctgagagccttcttcagcagctacctgaagagcctgcccgacgtgagaaagaagagcctgcccctgcccgagaagccccacaaggaggagaacagcgagatcgtggtgtggagagagttcgacaagagcaagctgtacaccgtggacctggagagcggcctgcactacctgctgagagtggagctggccgcccacaagagcctggccggcgccgagctgaagaccctgaaggacttcgtgaccgtgctggccaagctgttccccggcagaccccccgtgaagaagctgctggagatgctgcaggagtggctggccagcctgcccctggacagaatcccctacaacgccgtgctggacctggtgaacaacaagatgagaatcagcggcatcttcctgaccaaccacatcaagtgggtgggctgccagggcagcagaagcgagctgagaggctacccctgcagcctgtggaagctgttccacaccctgaccgtggaggccagcacccaccccgacgccctggtgggcaccggcttcgaggacgacccccaggccgtgctgcagaccatgagaagatacgtgcacaccttcttcggctgcaaggagtgcggcgagcacttcgaggagatggccaaggagagcatggacagcgtgaagacccccgaccaggccatcctgtggctgtggaagaagcacaacatggtgaacggcagactggccggccacctgagcgaggaccccagattccccaagctgcagtggcccacccccgacctgtgccccgcctgccacgaggagatcaagggcctggccagctgggacgagggccacgtgctgaccttcctgaagcagcactacggcagagacaacctgctggacacctacagcgccgaccagggcgacagcagcgagggcggcaccctggccagaggcgaggaggaggagaagagactgaccccccccgaggtgagccacggcgacagagacacccagagcgtgagaccccccggcgccctgggccccagacccgccctgcccgagagcctgcaccacagcctggacggcaagctgcagagcctggacggccccggcgcccacaaggaggtgggcggcgccgcccccttcctgggcgtggacttcagcagcctggacatgagcctgtgcgtggtgctgtacgtggccagcagcctgttcctgatggtgatgtacttcttcttcagagtgagaagcagaagatggaaggtgaagcaccaccaccccgccgtgtag

SEQ ID NO: 95995 - DNA, 948 bp, Artificial Sequence
  Description of Artificial Sequence: Synthetic coding sequence
atggaggagaagaaccaggccgtgtgccacgactacgacatccacttctaccccaccttcagatacttcaaggccttcaccaaggagttcaccaccggcgagaacttcaagggccccgacagagagctgagaaccgtgagacagaccatgatcgacttcctgcagaaccacaccgagggcagcagaccccccgcctgccccagactggaccccatccacgtgaagcccctgagagccttcttcagcagctacctgaagagcctgcccgacgtgagaaagaagagcctgcccctgcccgagaagccccacaaggaggagaacagcgagatcgtggtgtggagagagttcgacaagagcaagctgtacaccgtggacctggagagcggcctgcactacctgctgagagtggagctggccgcccacaagagcctggccggcgccgagctgaagaccctgaaggacttcgtgaccgtgctggccaagctgttccccggcagaccccccgtgaagaagctgctggagatgctgcaggagtggctggccagcctgcccctggacagaatcccctacaacgccgtgctggacctggtgaacaacaagatgagaatcagcggcatcttcctgaccaaccacatcaagtgggtgggctgccagggcagcagaagcgagctgagaggctacccctgcagcctgtggaagctgttccacaccctgaccgtggaggccagcacccaccccgacgccctggtgggcaccggcttcgaggacgacccccaggccgtgctgcagaccatgagaagatacgtgcacaccttcttcggctgcaaggagtgcggcgagcacttcgaggagatggccaaggagagcatggacagcgtgaagacccccgaccaggccatcctgtggctgtggaagaagcacaacatggtgaacggcagactggcctag

SEQ ID NO: 95996 - DNA, 735 bp, Artificial Sequence
  Description of Artificial Sequence: Synthetic coding sequence
atggccgccgccgccgccgccggcgaggccagaagagtgctggtgtacggcggcagaggcgccctgggcagcagatgcgtgcaggccttcagagccagaaactggtgggtggccagcgtggacgtggtggagaacgaggaggccagcgccagcatcatcgtgaagatgaccgacagcttcaccgagcaggccgaccaggtgaccgccgaggtgggcaagctgctgggcgaggagaaggtggacgccatcctgtgcgtggccggcggctgggccggcggcaacgccaagagcaagagcctgttcaagaactgcgacctgatgtggaagcagagcatctggaccagcaccatcagcagccacctggccaccaagcacctgaaggagggcggcctgctgaccctggccggcgccaaggccgccctggacggcacccccggcatgatcggctacggcatggccaagggcgccgtgcaccagctgtgccagagcctggccggcaagaacagcggcatgccccccggcgccgccgccatcgccgtgctgcccgtgaccctggacacccccatgaacagaaagagcatgcccgaggccgacttcagcagctggacccccctggagttcctggtggagaccttccacgactggatcaccggcaagaacagacccagcagcggcagcctgatccaggtggtgaccaccgagggcagaaccgagctgacccccgcctacttctag

SEQ ID NO: 95997 - DNA, 681 bp, Artificial Sequence
  Description of Artificial Sequence: Synthetic coding sequence
atggccgcccccctgctgcacaccagactgcccggcgacgccgccgccagccccagcgccgtgaagatgctgggcgccagcagaaccggcatcagcaacatgagagccctggagaacgacttcttcaacagcccccccagaaagaccgtgcagttcggcggcaccgtgaccgaggtgctgctgaagtacaagaccggcgagaccaacgacttcgagctgctgaagaaccagctgctggaccccgacatcaaggacgaccagatcatcaactggctgctggagttcagaagcagcatcatgtacctgaccaaggacttcgagcagctgatcagcatcatcctgagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacaccagccagagcctggccaacaacagcaagatctgcaccatcgacaccgtggtgagccacgccaacaccggcggcaagatcagcatctgcagcaagatcagagagaacaccggcatgctgagaagctag

SEQ ID NO: 95998 - DNA, 894 bp, Artificial Sequence
  Description of Artificial Sequence: Synthetic coding sequence
atggacgccgagggcctggccctgctgctgccccccgtgaccctggccgccctggtggacagctggctgagagaggactgccccggcctgaactacgccgccctggtgagcggcgccggccccagccaggccgccctgtgggccaagagccccggcgtgctggccggccagcccttcttcgacgccatcttcacccagctgaactgccaggtgagctggttcctgcccgagggcagcaagctggtgcccgtggccagagtggccgaggtgagaggccccgcccactgcctgctgctgggcgagagagtggccctgaacaccctggccagatgcagcggcatcgccagcgccgccgccgccgccgtggaggccgccagaggcgccggctggaccggccacgtggccggcaccagaaagaccacccccggcttcagactggtggagaagtacggcctgctggtgggcggcgccgccagccacagatacgacctgggcggcctggtgatggtgaaggacaaccacgtggtggccgccggcggcgtggagaaggccgtgagagccgccagacaggccgccgacttcaccctgaaggtggaggtggagtgcagcagcctgcaggaggccgtgcaggccgccgaggccggcgccgacctggtgctgctggacaacttcaagcccgaggagctgcaccccaccgccaccgtgctgaaggcccagttccccagcgtggccgtggaggccagcggcggcatcaccctggacaacctgccccagttctgcggcccccacatcgacgtgatcagcatgggcatgctgacccaggccgcccccgccctggacttcagcctgaagctgttcgccaaggaggtggcccccgtgcccaagatccactag

SEQ ID NO: 95999 - DNA, 498 bp, Artificial Sequence
  Description of Artificial Sequence: Synthetic coding sequence
atggacgccgagggcctggccctgctgctgccccccgtgaccctggccgccctggtggacagctggctgagagaggactgccccggcctgaactacgccgccctggtgagcggcgccggccccagccaggccgccctgtgggccaagagccccggcgtgctggccggccagcccttcttcgacgccatcttcacccagctgaactgccaggtgagctggttcctgcccgagggcagcaagctggtgcccgtggccagagtggccgaggtgagaggccccgcccactgcctgctgctgggcgagagagtggccctgaacaccctggccagatgcagcggcatcgccagcgccgccgccgccgccgtggaggccgccagaggcgccggctggaccggccacgtggccggcaccagaaagaccacccccggcttcagactggtggagaagtacggcctgctggtgggcggcgccgccagccacagatacgacctgggctag

SEQ ID NO: 96000 - DNA, 2154 bp, Artificial Sequence
  Description of Artificial Sequence: Synthetic coding sequence
atggccgtggccgtgagaaccctgcaggagcagctggagaaggccaaggagagcctgaagaacgtggacgagaacatcagaaagctgaccggcagagaccccaacgacgtgagacccatccaggccagactgctggccctgagcggccccggcggcggcagaggcagaggcagcctgctgctgagaagaggcttcagcgacagcggcggcggcccccccgccaagcagagagacctggagggcgccgtgagcagactgggcggcgagagaagaaccagaagagagagcagacaggagagcgaccccgaggacgacgacgtgaagaagcccgccctgcagagcagcgtggtggccaccagcaaggagagaaccagaagagacctgatccaggaccagaacatggacgagaagggcaagcagagaaacagaagaatcttcggcctgctgatgggcaccctgcagaagttcaagcaggagagcaccgtggccaccgagagacagaagagaagacaggagatcgagcagaagctggaggtgcaggccgaggaggagagaaagcaggtggagaacgagagaagagagctgttcgaggagagaagagccaagcagaccgagctgagactgctggagcagaaggtggagctggcccagctgcaggaggagtggaacgagcacaacgccaagatcatcaagtacatcagaaccaagaccaagccccacctgttctacatccccggcagaatgtgccccgccacccagaagctgatcgaggagagccagagaaagatgaacgccctgttcgagggcagaagaatcgagttcgccgagcagatcaacaagatggaggccagacccagaagacagagcatgaaggagaaggagcaccaggtggtgagaaacgaggagcagaaggccgagcaggaggagggcaaggtggcccagagagaggaggagctggaggagaccggcaaccagcacaacgacgtggagatcgaggaggccggcgaggaggaggagaaggagatcgccatcgtgcacagcgacgccgagaaggagcaggaggaggaggagcagaagcaggagatggaggtgaagatggaggaggagaccgaggtgagagagagcgagaagcagcaggacagccagcccgaggaggtgatggacgtgctggagatggtggagaacgtgaagcacgtgatcgccgaccaggaggtgatggagaccaacagagtggagagcgtggagcccagcgagaacgaggccagcaaggagctggagcccgagatggagttcgagatcgagcccgacaaggagtgcaagaccctgagccccggcaaggagaacgtgagcgccctggacatggagaaggagagcgaggagaaggaggagaaggagagcgagccccagcccgagcccgtggcccagccccagccccagagccagccccagctgcagctgcagagccagagccagcccgtgctgcagagccagccccccagccagcccgaggacctgagcctggccgtgctgcagcccaccccccaggtgacccaggagcagggccacctgctgcccgagagaaaggacttccccgtggagagcgtgaagctgaccgaggtgcccgtggagcccgtgctgaccgtgcaccccgagagcaagagcaagaccaagaccagaagcagaagcagaggcagagccagaaacaagaccagcaagagcagaagcagaagcagcagcagcagcagcagcagcagcagcagcaccagcagcagcagcggcagcagcagcagcagcggcagcagcagcagcagaagcagcagcagcagcagcagcagcaccagcggcagcagcagcagagacagcagcagcagcaccagcagcagcagcgagagcagaagcagaagcagaggcagaggccacaacagagacagaaagcacagaagaagcgtggacagaaagagaagagacaccagcggcctggagagaagccacaagagcagcaagggcggcagcagcagagacaccaagggcagcaaggacaagaacagcagaagcgacagaaagagaagcatcagcgagagcagcagaagcggcaagagaagcagcagaagcgagagagacagaaagagcgacagaaaggacaagagaagatag

SEQ ID NO: 96001 - DNA, 1704 bp, Artificial Sequence; identical to SEQ ID NO: 78299
  Description of Artificial Sequence: Synthetic coding sequence

SEQ ID NO: 96002 - DNA, 996 bp, Artificial Sequence
  Description of Artificial Sequence: Synthetic coding sequence
atgggcaccccccagaaggacgtgatcatcaagagcgacgcccccgacaccctgctgctggagaagcacgccgactacatcgccagctacggcagcaagaaggacgactacgagtactgcatgagcgagtacctgagaatgagcggcatctactggggcctgaccgtgatggacctgatgggccagctgcacagaatgaacagagaggagatcctggccttcatcaagagctgccagcacgagtgcggcggcatcagcgccagcatcggccacgacccccacctgctgtacaccctgagcgccgtgcagatcctgaccctgtacgacagcatcaacgtgatcgacgtgaacaaggtggtggagtacgtgaagggcctgcagaaggaggacggcagcttcgccggcgacatctggggcgagatcgacaccagattcagcttctgcgccgtggccaccctggccctgctgggcaagctggacgccatcaacgtggagaaggccatcgagttcgtgctgagctgcatgaacttcgacggcggcttcggctgcagacccggcagcgagagccacgccggccagatctactgctgcaccggcttcctggccatcaccagccagctgcaccaggtgaacagcgacctgctgggctggtggctgtgcgagagacagctgcccagcggcggcctgaacggcagacccgagaagctgcccgacgtgtgctacagctggtgggtgctggccagcctgaagatcatcggcagactgcactggatcgacagagagaagctgagaaacttcatcctggcctgccaggacgaggagaccggcggcttcgccgacagacccggcgacatggtggaccccttccacaccctgttcggcatcgccggcctgagcctgctgggcgaggagcagatcaagcccgtgaaccccgtgttctgcatgcccgaggaggtgctgcagagagtgaacgtgcagcccgagctggtgagctag

SEQ ID NO: 96003 - DNA, 963 bp, Artificial Sequence
  Description of Artificial Sequence: Synthetic coding sequence
atgggcaccccccagaaggacgtgatcatcaagagcgacgcccccgacaccctgctgctggagaagcacgccgactacatcgccagctacggcagcaagaaggacgactacgagtactgcatgagcgagtacctgagaatgagcggcatctactggggcctgaccgtgatggacctgatgggccagctgcacagaatgaacagagaggagatcctggccttcatcaagagctgccagcacgagtgcggcggcatcagcgccagcatcggccacgacccccacctgctgtacaccctgagcgccgtgcagatcctgaccctgtacgacagcatcaacgtgatcgacgtgaacaaggtggtggagtacgtgaagggcctgcagaaggaggacggcagcttcgccggcgacatctggggcgagatcgacaccagattcagcttctgcgccgtggccaccctggccctgctgggcaagctggacgccatcaacgtggagaaggccatcgagttcgtgctgagctgcatgaacttcgacggcggcttcggctgcagacccggcagcgagagccacgccggccagatctactgctgcaccggcttcctggccatcaccagccagctgcaccaggtgaacagcgacctgctgggctggtggctgtgcgagagacagctgcccagcggcggcctgaacggcagacccgagaagctgcccgacgtgtgctacagctggtgggtgctggccagcctgaagatcatcggcagactgcactggatcgacagagagaagctgagaaacttcatcctggcctgccaggacgaggagaccggcggcttcgccgacagacccggcgacatgcacttcatctaccagaactaccccaagaaggagctgagcagcaacaaggagaccctgaccgagagcctgctgcccagactggagagaagcagcaccatcagcgcctag

SEQ ID NO: 96004 - DNA, 459 bp, Artificial Sequence
  Description of Artificial Sequence: Synthetic coding sequence
atgggcaccccccagaaggacgtgatcatcaagagcgacgcccccgacaccctgctgctggagaagcacgccgactacatcgccagctacggcagcaagaaggacgactacgagtactgcatgagcgagtacctgagaatgagcggcatctactggggcctgaccgtgatggacctgatgggccagctgcacagaatgaacagagaggagatcctggccttcatcaagagctgccagcacgagtgcggcggcatcagcgccagcatcggccacgacccccacctgctgtacaccctgagcgccgtgcagatcctgaccctgtacgacagcatcaacgtgatcgacgtgaacaaggtggtggagtacgtgaagggcctgcagaaggaggacggcagcttcgccggcgacatctggggcaacgtgagattcagccccttctaccccaagtaccagtactag

SEQ ID NO: 96005 - DNA, 474 bp, Artificial Sequence
  Description of Artificial Sequence: Synthetic coding sequence
atgaacttcgacggcggcttcggctgcagacccggcagcgagagccacgccggccagatctactgctgcaccggcttcctggccatcaccagccagctgcaccaggtgaacagcgacctgctgggctggtggctgtgcgagagacagctgcccagcggcggcctgaacggcagacccgagaagctgcccgacgtgtgctacagctggtgggtgctggccagcctgaagatcatcggcagactgcactggatcgacagagagaagctgagaaacttcatcctggcctgccaggacgaggagaccggcggcttcgccgacagacccggcgacatggtggaccccttccacaccctgttcggcatcgccggcctgagcctgctgggcgaggagcagatcaagcccgtgaaccccgtgttctgcatgcccgaggaggtgctgcagagagtgaacgtgcagcccgagctggtgagctag

SEQ ID NO: 96006 - DNA, 1476 bp, Artificial Sequence; identical to SEQ ID NO: 93963
  Description of Artificial Sequence: Synthetic coding sequence

SEQ ID NO: 96007 - DNA, 1518 bp, Artificial Sequence
  Description of Artificial Sequence: Synthetic coding sequence
atgatggccagcagctaccacgaggtggtgagcagaaagaagatgagcctgaagagcgagagaagaggcatccacgtggaccagagcgacctgctgtgcaagaagggctgcggctactacggcaaccccgcctggcagggcttctgcagcaagtgctggagagaggagtaccacaaggccagacagaagcagatccaggaggactgggagctggccgagagactgcagagagaggaggaggaggccttcgccagcagccagagcagccagggcgcccagagcctgaccttcagcaagttcgaggagaagaagaccaacgagaagaccagaaaggtgaccaccgtgaagaagttcttcagcgccagcagcagagtgggcagcaagaaggagatccaggaggccaaggcccccagccccagcatcaacagacagaccagcatcgagaccgacagagtgagcaaggagttcatcgagttcctgaagaccttccacaagaccggccaggagatctacaagcagaccaagctgttcctggagggcatgcactacaagagagacctgagcatcgaggagcagagcgagtgcgcccaggacttctaccacaacgtggccgagagaatgcagaccagaggcaaggtgccccccgagagagtggagaagatcatggaccagatcgagaagtacatcatgaccagactgtacaagtacgtgttctgccccgagaccaccgacgacgagaagaaggacctggccatccagaagagaatcagagccctgagatgggtgaccccccagatgctgtgcgtgcccgtgaacgaggacatccccgaggtgagcgacatggtggtgaaggccatcaccgacatcatcgagatggacagcaagagagtgcccagagacaagctggcctgcatcaccaagtgcagcaagcacatcttcaacgccatcaagatcaccaagaacgagcccgccagcgccgacgacttcctgcccaccctgatctacatcgtgctgaagggcaacccccccagactgcagagcaacatccagtacatcaccagattctgcaaccccagcagactgatgaccggcgaggacggctactacttcaccaacctgtgctgcgccgtggccttcatcgagaagctggacgcccagagcctgaacctgagccaggaggacttcgacagatacatgagcggccagaccagccccagaaagcaggaggccgagagctggagccccgacgcctgcctgggcgtgaagcagatgtacaagaacctggacctgctgagccagctgaacgagagacaggagagaatcatgaacgaggccaagaagctggagaaggacctgatcgactggaccgacggcatcgccagagaggtgcaggacatcgtggagaagtaccccctggagatcaagccccccaaccagcccctggccgccatcgacagcgagaacgtggagaacgacaagctgcccccccccctgcagccccaggtgtacgccggctag

SEQ ID NO: 96008 - DNA, 138 bp, Artificial Sequence
  Description of Artificial Sequence: Synthetic coding sequence
atgagcctgaagagcgagagaagaggcatccacgtggaccagagcgacctgctgtgcaagaagggctgcggctactacggcaaccccgcctggcagggcttctgcagcaagtgctggagagaggagtaccacaagtag

SEQ ID NO: 96009 - DNA, 1476 bp, Artificial Sequence; identical to SEQ ID NO: 93963
  Description of Artificial Sequence: Synthetic coding sequence

SEQ ID NO: 96010 - DNA, 372 bp, Artificial Sequence
  Description of Artificial Sequence: Synthetic coding sequence
atggagcccgccgagcagcccagcgagctggtgagcgccgagggcagaaacagaaaggccgtgctgtgccagagatgcggcagcagagtgctgcagcccggcaccgccctgttcagcagaagacagctgttcctgcccagcatgagaaagaagcccgccctgagcgacggcagcaaccccgacggcgacctgctgcaggagcactggctggtggaggacatgttcatcttcgagaacgtgggcttcaccaaggacgtgggcaacatcaagttcctggtgtgcgccgactgcgagatcggccccatcggctggcactgcctggacgacaagaacagcttctacgtggccctggagagagtgagccacgagtag

SEQ ID NO: 96011 - DNA, 1206 bp, Artificial Sequence
  Description of Artificial Sequence: Synthetic coding sequence
atggagcccagaagagccgcccccggcgtgcccggctggggcagcagagaggccgccggcagcgccagcgccgccgagctggtgtaccacctggccggcgccctgggcaccgagctgcaggacctggccagaagattcggccccgaggccgccgccggcctggtgcccctggtggtgagagccctggagctgctggagcaggccgccgtgggccccgcccccgacagcctgcaggtgagcgcccagcccgccgagcaggagctgagaagactgagagaggagaacgagagactgagaagagagctgagagccggcccccaggaggagagagccctgctgagacagctgaaggaggtgaccgacagacagagagacgagctgagagcccacaacagagacctgagacagagaggccaggagaccgaggccctgcaggagcagctgcagagactgctgctggtgaacgccgagctgagacacaagctggccgccatgcagacccagctgagagccgcccaggacagagagagagagagacagcagcccggcgaggccgccaccccccaggccaaggagagagccagaggccaggccggcagacccggccaccagcacggccaggagcccgagtgggccaccgccggcgccggcgcccccggcaaccccgaggaccccgccgaggccgcccagcagctgggcagacccagcgaggccggccagtgcagattcagcagagaggagttcgagcagatcctgcaggagagaaacgagctgaaggccaaggtgttcctgctgaaggaggagctggcctacttccagagagagctgctgaccgaccacagagtgcccggcctgctgctggaggccatgaaggtggccgtgagaaagcagagaaagaagatcaaggccaagatgctgggcacccccgaggaggccgagagcagcgaggacgaggccggcccctggatcctgctgagcgacgacaagggcgaccacccccccccccccgagagcaagatccagagcttcttcggcctgtggtacagaggcaaggccgagagcagcgaggacgagaccagcagccccgcccccagcaagctgggcggcgaggaggaggcccagccccagagccccgcccccgaccccccctgcagcgccctgcacgagcacctgtgcctgggcgccagcgccgcccccgaggcctag

SEQ ID NO: 96012 - DNA, 1212 bp, Artificial Sequence
  Description of Artificial Sequence: Synthetic coding sequence
atggaggaggagagaggcagcgccctggccgccgagagcgccctggagaagaacgtggccgagctgaccgtgatggacgtgtacgacatcgccagcctggtgggccacgagttcgagagagtgatcgaccagcacggctgcgaggccatcgccagactgatgcccaaggtggtgagagtgctggagatcctggaggtgctggtgagcagacaccacgtggcccccgagctggacgagctgagactggagctggacagactgagactggagagaatggacagaatcgagaaggagagaaagcaccagaaggagctggagctggtggaggacgtgtggagaggcgaggcccaggacctgctgagccagatcgcccagctgcaggaggagaacaagcagctgatgaccaacctgagccacaaggacgtgaacttcagcgaggaggagttccagaagcacgagggcatgagcgagagagagagacaggtgatgaagaagctgaaggaggtggtggacaagcagagagacgagatcagagccaaggacagagagctgggcctgaagaacgaggacgtggaggccctgcagcagcagcagaccagactgatgaagatcaaccacgacctgagacacagagtgaccgtggtggaggcccagggcaaggccctgatcgagcagaaggtggagctggaggccgacctgcagaccaaggagcaggagatgggcagcctgagagccgagctgggcaagctgagagagagactgcagggcgagcacagccagaacggcgaggaggagcccgagaccgagcccgtgggcgaggagagcatcagcgacgccgagaaggtggccatggacctgaaggaccccaacagacccagattcaccctgcaggagctgagagacgtgctgcacgagagaaacgagctgaagagcaaggtgttcctgctgcaggaggagctggcctactacaagagcgaggagatggaggaggagaacagaatcccccagcccccccccatcgcccaccccagaaccagcccccagcccgagagcggcatcaagagactgttcagcttcttcagcagagacaagaagagactggccaacacccagagaaacgtgcacatccaggagagcttcggccagtgggccaacacccacagagacgacggctacaccgagcagggccaggaggccctgcagcacctgtag

SEQ ID NO: 96013 - DNA, 636 bp, Artificial Sequence
  Description of Artificial Sequence: Synthetic coding sequence
atggaggagccccccgtgagagaggaggaggaggaggagggcgaggaggacgaggagagagacgaggtgggccccgagggcgccctgggcaagagccccttccagctgaccgccgaggacgtgtacgacatcagctacctgctgggcagagagctgatggccctgggcagcgaccccagagtgacccagctgcagttcaaggtggtgagagtgctggagatgctggaggccctggtgaacgagggcagcctggccctggaggagctgaagatggagagagaccacctgagaaaggaggtggagggcctgagaagacagagcccccccgccagcggcgaggtgaacctgggccccaacaagatggtggtggacctgaccgaccccaacagacccagattcaccctgcaggagctgagagacgtgctgcaggagagaaacaagctgaagagccagctgctggtggtgcaggaggagctgcagtgctacaagagcggcctgatcccccccagagagggccccggcggcagaagagagaaggacgccgtggtgaccagcgccaagaacgccggcagaaacaaggaggagaagaccatcatcaagaagctgttcttcttcagaagcggcaagcagacctag

SEQ ID NO: 96014 - DNA, 717 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcagaaccatcctggtggacttctgggacaccgccggccaggagagattccagagcatgcacgccagctactaccacaaggcccacgcctgcatcatggtgttcgacgtgcagagaaaggtgacctacagaaacctgagcacctggtacaccgagctgagagagttcagacccgagatcccctgcatcgtggtggccaacaagatcgacgacatcaacgtgacccagaagagcttcaacttcgccaagaagttcagcctgcccctgtacttcgtgagcgccgccgacggcaccaacgtggtgaaggtgtggctgaccgccgaggtggccagcaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggccgccagcccccacagctag

SEQ ID NO: 96015 - DNA, 498 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggccgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggtggccagcccccacagctag

SEQ ID NO: 96016 - DNA, 690 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggacttctgggacaccgccggccaggagagattccagagcatgcacgccagctactaccacaaggcccacgcctgcatcatggtgttcgacatccagagaaaggtgacctacagaaacctgagcacctggtacaccgagctgagagagttcagacccgagatcccctgcatcgtggtggccaacaagatcgacgccgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggtggccagcccccacagctag

SEQ ID NO: 96017 - DNA, 687 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggacttctgggacaccgccggccaggagagattccagagcatgcacgccagctactaccacaaggcccacgcctgcatcatggtgttcgacatccagagaaaggtgacctacagaaacctgagcacctggtacaccgagctgagagagttcagacccgagatcccctgcatcgtggtggccaacaagatcgacgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggtggccagcccccacagctag

SEQ ID NO: 96018 - DNA, 687 bp, Artificial Sequence; identical to SEQ ID NO: 96017
  Description of Artificial Sequence: Synthetic coding sequence

SEQ ID NO: 96019 - DNA, 717 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggacttctgggacaccgccggccaggagagattccagagcatgcacgccagctactaccacaaggcccacgcctgcatcatggtgttcgacatccagagaaaggtgacctacagaaacctgagcacctggtacaccgagctgagagagttcagacccgagatcccctgcatcgtggtggccaacaagatcgacgacatcaacgtgacccagaagagcttcaacttcgccaagaagttcagcctgcccctgtacttcgtgagcgccgccgacggcaccaacgtggtgaaggtgtggctgaccgccgaggtggccagcaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggtggccagcccccacagctag

SEQ ID NO: 96020 - DNA, 345 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggacttctgggacaccgccggccaggagagattccagagcatgcacgccagctactaccacaaggcccacgcctgcatcatggtgttcgacatccagagaaaggtgacctacagaaacctgagcacctag

SEQ ID NO: 96021 - DNA, 306 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcaagaccatcctggtggacttctgggacaccgccggccaggagagattccagagcatgcacgccagctactaccacaaggcccacgcctgcatcatgcagacctag

SEQ ID NO: 96022 - DNA, 690 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcagaaccatcctggtggacttctgggacaccgccggccaggagagattccagagcatgcacgccagctactaccacaaggcccacgcctgcatcatggtgttcgacgtgcagagaaaggtgacctacagaaacctgagcacctggtacaccgagctgagagagttcagacccgagatcccctgcatcgtggtggccaacaagatcgacgccgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggccgccagcccccacagctag

SEQ ID NO: 96023 - DNA, 690 bp, Artificial Sequence; identical to SEQ ID NO: 96022
  Description of Artificial Sequence: Synthetic coding sequence

SEQ ID NO: 96024 - DNA, 687 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcagaaccatcctggtggacttctgggacaccgccggccaggagagattccagagcatgcacgccagctactaccacaaggcccacgcctgcatcatggtgttcgacgtgcagagaaaggtgacctacagaaacctgagcacctggtacaccgagctgagagagttcagacccgagatcccctgcatcgtggtggccaacaagatcgacgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggccgccagcccccacagctag

SEQ ID NO: 96025 - DNA, 63 bp, Artificial Sequence
  Description of Artificial Sequence: Synthetic coding sequence
atggccgaggacaagaccaagcccagcgagctggaccagggcaagtacgacgccgacgactag

SEQ ID NO: 96026 - DNA, 687 bp, Artificial Sequence; identical to SEQ ID NO: 96024
  Description of Artificial Sequence: Synthetic coding sequence

SEQ ID NO: 96027 - DNA, 603 bp, Artificial Sequence
  Description of Artificial Sequence: Synthetic coding sequence
atggccaagaagacctacgacctgctgttcaagctgctgctgatcggcgacagcggcgtgggcaagacctgcgtgctgttcagattcagcgacgacgccttcaacaccaccttcatcagcaccatcggcatcgacttcaagatcaagaccgtggagctgcagggcaagaagatcaagctgcagatctgggacaccgccggccaggagagattccacaccatcaccaccagctactacagaggcgccatgggcatcatgctggtgtacgacatcaccaacggcaagagcttcgagaacatcagcaagtggctgagaaacatcgacgagcacgccaacgaggacgtggagagaatgctgctgggcaacaagtgcgacatggacgacaagagagtggtgcccaagggcaagggcgagcagatcgccagagagcacggcatcagattcttcgagaccagcgccaaggccaacatcaacatcgagaaggccttcctgaccctggccgaggacatcctgagaaagacccccgtgaaggagcccaacagcgagaacgtggacatcagcagcggcggcggcgtgaccggctggaagagcaagtgctgctag

SEQ ID NO: 96028 - DNA, 1950 bp, Artificial Sequence
  Description of Artificial Sequence: Synthetic coding sequence
atgagcctgatggtgagcgccggcagaggcctgggcgccgtgtggagccccacccacgtgcaggtgaccgtgctgcaggccagaggcctgagagccaagggccccggcggcaccagcgacgcctacgccgtgatccaggtgggcaaggagaagtacgccaccagcgtgagcgagagaagcctgggcgcccccgtgtggagagaggaggccaccttcgagctgcccagcctgctgagcagcggccccgccgccgccgccaccctgcagctgaccgtgctgcacagagccctgctgggcctggacaagttcctgggcagagccgaggtggacctgagagacctgcacagagaccagggcagaagaaagacccagtggtacaagctgaagagcaagcccggcaagaaggacaaggagagaggcgagatcgaggtggacatccagttcatgagaaacaacatgaccgccagcatgttcgacctgagcatgaaggacaagagcagaaaccccttcggcaagctgaaggacaagatcaagggcaagaacaaggacagcggcagcgacaccgccagcgccatcatccccagcaccacccccagcgtggacagcgacgacgagagcgtggtgaaggacaagaagaagaagagcaagatcaagaccctgctgagcaagagcaacctgcagaagacccccctgagccagagcatgagcgtgctgcccaccagcaagcccgagaaggtgctgctgagacccggcgacttccagagccagtgggacgaggacgacaacgaggacgagagcagcagcgccagcgacgtgatgagccacaagagaaccgccagcaccgacctgaagcagctgaaccaggtgaacttcaccctgcccaagaaggagggcctgagcttcctgggcggcctgagaagcaagaacgacgtgctgagcagaagcaacgtgtgcatcaacggcaaccacgtgtacctggagcagcccgaggccaagggcgagatcaaggacagcagccccagcagcagccccagccccaagggcttcagaaagaagcacctgttcagcagcaccgagaacctggccgccggcagctggaaggagcccgccgagggcggcggcctgagcagcgacagacagctgagcgagagcagcaccaaggacagcctgaagagcatgaccctgcccagctacagacccgcccccctggtgagcggcgacctgagagagaacatggcccccgccaacagcgaggccaccaaggaggccaaggagagcaagaagcccgagagcagaagaagcagcctgctgagcctgatgaccggcaagaaggacgtggccaagggcagcgagggcgagaaccccctgaccgtgcccggcagagagaaggagggcatgctgatgggcgtgaagcccggcgaggacgccagcggccccgccgaggacctggtgagaagaagcgagaaggacaccgccgccgtggtgagcagacagggcagcagcctgaacctgttcgaggacgtgcagatcaccgagcccgaggccgagcccgagagcaagagcgagcccagaccccccatcagcagccccagagccccccagaccagagccgtgaagcccagactgcaccccgtgaagcccatgaacgccatggccaccaaggtggccaactgcagcctgggcaccgccaccatcatcagcgagaacctgaacaacgaggtgatgatgaagaagtacagccccagcgaccccgccttcgcctacgcccagctgacccacgacgagctgatccagctggtgctgaagcagaaggagaccatcagcaagaaggagttccaggtgagagagctggaggactacatcgacaacctgctggtgagagtgatggaggagacccccaacatcctgagaatccccacccaggtgggcaagaaggccggcaagatgtag

SEQ ID NO: 96029 - DNA, 3852 bp, Artificial Sequence
  Description of Artificial Sequence: Synthetic coding sequence
atgagcctgatggtgagcgccggcagaggcctgggcgccgtgtggagccccacccacgtgcaggtgaccgtgctgcaggccagaggcctgagagccaagggccccggcggcaccagcgacgcctacgccgtgatccaggtgggcaaggagaagtacgccaccagcgtgagcgagagaagcctgggcgcccccgtgtggagagaggaggccaccttcgagctgcccagcctgctgagcagcggccccgccgccgccgccaccctgcagctgaccgtgctgcacagagccctgctgggcctggacaagttcctgggcagagccgaggtggacctgagagacctgcacagagaccagggcagaagaaagacccagtggtacaagctgaagagcaagcccggcaagaaggacaaggagagaggcgagatcgaggtggacatccagttcatgagaaacaacatgaccgccagcatgttcgacctgagcatgaaggacaagagcagaaaccccttcggcaagctgaaggacaagatcaagggcaagaacaaggacagcggcagcgacaccgccagcgccatcatccccagcaccacccccagcgtggacagcgacgacgagagcgtggtgaaggacaagaagaagaagagcaagatcaagaccctgctgagcaagagcaacctgcagaagacccccctgagccagagcatgagcgtgctgcccaccagcaagcccgagaaggtgctgctgagacccggcgacttccagagccagtgggacgaggacgacaacgaggacgagagcagcagcgccagcgacgtgatgagccacaagagaaccgccagcaccgacctgaagcagctgaaccaggtgaacttcaccctgcccaagaaggagggcctgagcttcctgggcggcctgagaagcaagaacgacgtgctgagcagaagcaacgtgtgcatcaacggcaaccacgtgtacctggagcagcccgaggccaagggcgagatcaaggacagcagccccagcagcagccccagccccaagggcttcagaaagaagcacctgttcagcagcaccgagaacctggccgccggcagctggaaggagcccgccgagggcggcggcctgagcagcgacagacagctgagcgagagcagcaccaaggacagcctgaagagcatgaccctgcccagctacagacccgcccccctggtgagcggcgacctgagagagaacatggcccccgccaacagcgaggccaccaaggaggccaaggagagcaagaagcccgagagcagaagaagcagcctgctgagcctgatgaccggcaagaaggacgtggccaagggcagcgagggcgagaaccccctgaccgtgcccggcagagagaaggagggcatgctgatgggcgtgaagcccggcgaggacgccagcggccccgccgaggacctggtgagaagaagcgagaaggacaccgccgccgtggtgagcagacagggcagcagcctgaacctgttcgaggacgtgcagatcaccgagcccgaggccgagcccgagagcaagagcgagcccagaccccccatcagcagccccagagccccccagaccagagccgtgaagcccagactggaggtgagccccgaggcccagcccaccgccagactgcccagccccaccgacagccccagcagcctgccccccctgcccagcagcagcggccaggccagcgtgcccagcgagctgggccacggcgccgacacccagagcagcgagagccccagcgtgttcagcagcctgagcagccccatcgccgcccccatcagcaccagcacccccatcgagagctggcccctggtggacagaggccaggccaagagcgagggcccccccctgctgcccaaggccgagctgcagaccgagagcctgacccccgtgcccaacagcggcagcagcgccctgggcagcctgttcaagcagcccagcttccccgccaacaagggcaccgaggacagcctgatgggcagaaccagagagaccggcaccgagaagaacaccagcagcctggagctggaggagagcctgcccgagcagcccgagaccggcagacaggaggaggagctgcccagattcccctgcaagaagcaggactacagccccagcagcggcgaggcccaggaggtgcccttcgccctgagcctgagcagcgacggcgccgtgagccccgtgggcgagctggccgccggcggcgacagagacctggagagccaggccggcagcctggtggagagcaaggccagagacgccgccgaggaggtggccccccccctgcccatgggcgccagcgtgcccagcatcgacagcatgatgagaaagctggaggagatgggcctgaacctgagaaaggaccagaagaagaccaagaagagagtgagcttcagcgagcagctgttcaccgaggaggccgtggccggcgccgccctgctggtggagggccacagcagctgcccccaggagctgaaccccgcctggagcgtggccggcaacgccagcgacggcgagccccccgagagcccccacgccgaggacagcgagagagagagcgtgaccacccccggccccgccacctgcggcgcccccgccagccccgccgaccacctgctgctgcccagccaggaggagagcttcagcgaggtgcccatgagcgaggccagcagcgccaaggacacccccctgttcagaatggagggcgaggacgccctggtgacccagtaccagagcaaggccagcgaccacgagggcctgctgagcgaccccctgagcgacctgcagctggtgagcgacttcaagagccccatcatggccgacctgaacctgagcctgcccagcatccccgaggtggccagcgacgacgagagaatcgaccaggtggaggacgacggcgaccaggtggaggacgacggcgagaccgccaagagcagcaccctggacatcggcgccctgagcctgggcctggtggtgccctgccccgagagaggcaagggccccagcggcgaggccgacagactggtgctgggcgagggcctgtgcgacttcagactgcaggccccccaggccagcgtgaccgcccccagcgagcagaccaccgagttcggcatccacaagccccacctgggcaagagcagcagcctggacaagcagctgcccggccccagcggcggcgaggaggagaagcccatgggcaacggcagccccagccccccccccggcaccagcctggacaaccccgtgcccagccccagccccagcgagatcttccccgtgacccacagcttccccagcagcgcccacagcgacacccaccacaccagcaccgccgagagccagaagaaggccaccgccgagggcagcgccggcagagtggagaacttcggcaagagaaagcccctgctgcaggcctgggtgagccccagcgagacccaccccgtgagcgcccagcccggcgccggcaccggcagcgccaagcacagactgcaccccgtgaagcccatgaacgccatggccaccaaggtggccaactgcagcctgggcaccgccaccatcatcagcgagaacctgaacaacgaggtgatgatgaagaagtacagccccagcgaccccgccttcgcctacgcccagctgacccacgacgagctgatccagctggtgctgaagcagaaggagaccatcagcaagaaggagttccaggtgagagagctggaggactacatcgacaacctgctggtgagagtgatggaggagacccccaacatcctgagaatccccacccaggtgggcaagaaggccggcaagatgtag

SEQ ID NO: 96030 - DNA, 429 bp, Artificial Sequence
  Description of Artificial Sequence: Synthetic coding sequence
atgagcctgatggtgagcgccggcagaggcctgggcgccgtgtggagccccacccacgtgcaggtgaccgtgctgcaggccagaggcctgagagccaagggccccggcggcaccagcgacgcctacgccgtgatccaggtgggcaaggagaagtacgccaccagcgtgagcgagagaagcctgggcgcccccgtgtggagagaggaggccaccttcgagctgcccagcctgctgagcagcggccccgccgccgccgccaccctgcagctgaccgtgctgcacagagccctgctgggcctggacaagttcctgggcagagccgaggtggacctgagagacctgcacagagacctgggcaagagcttcttcaagaccctgaagaagagagcctgggccatcttcctgagactgtgcctgaagaagaactag

SEQ ID NO: 96031 - DNA, 1320 bp, Artificial Sequence
  Description of Artificial Sequence: Synthetic coding sequence
atgagaaacaacatgaccgccagcatgttcgacctgagcatgaaggacaagagcagaaaccccttcggcaagctgaaggacaagatcaagggcaagaacaaggacagcggcagcgacaccgccagcgccatcatccccagcaccacccccagcgtggacagcgacgacgagagcgtggtgaaggacaagaagaagaagagcaagatcaagaccctgctgagcaagagcaacctgcagaagacccccctgagccagagcatgagcgtgctgcccaccagcaagcccgagaaggtgctgctgagacccggcgacttccagagccagtgggacgaggacgacaacgaggacgagagcagcagcgccagcgacgtgatgagccacaagagaaccgccagcaccgacctgaagcagctgaaccaggtgaacttcaccctgcccaagaaggagggcctgagcttcctgggcggcctgagaagcaagaacgacgtgctgagcagaagcaacgtgtgcatcaacggcaaccacgtgtacctggagcagcccgaggccaagggcgagatcaaggacagcagccccagcagcagccccagccccaagggcttcagaaagaagcacctgttcagcagcaccgagaacctggccgccggcagctggaaggagcccgccgagggcggcggcctgagcagcgacagacagctgagcgagagcagcaccaaggacagcctgaagagcatgaccctgcccagctacagacccgcccccctggtgagcggcgacctgagagagaacatggcccccgccaacagcgaggccaccaaggaggccaaggagagcaagaagcccgagagcagaagaagcagcctgctgagcctgatgaccggcaagaaggacgtggccaagggcagcgagggcgagaaccccctgaccgtgcccggcagagagaaggagggcatgctgatgggcgtgaagcccggcgaggacgccagcggccccgccgaggacctggtgagaagaagcgagaaggacaccgccgccgtggtgagcagacagggcagcagcctgaacctgttcgaggacgtgcagatcaccgagcccgaggccgagcccgagagcaagagcgagcccagaccccccatcagcagccccagagccccccagaccagagccgtgaagcccagactgcaccccgtgaagcccatgaacgccatggccaccaaggtggccaactgcagcctgggcaccgccaccatcatcagcgagaacctgaacaacgaggtgatgatgaaggtgtgccccctgagaagctggtgcgtgagatag

SEQ ID NO: 96032 - DNA, 1539 bp, Artificial Sequence
  Description of Artificial Sequence: Synthetic coding sequence
atgatgctgagcgagcaggcccagaagtggttccccacccacgtgcaggtgaccgtgctgcaggccaaggacctgaagcccaagggcaagagcggcaccaacgacacctacaccatcatccagctgggcaaggagaagtacagcaccagcgtggccgagaagaccctggagcccgtgtggaaggaggaggccagcttcgagctgcccggcctgctgatccagggcagccccgagaagtacatcctgttcctgatcgtgatgcacagaagcctggtgggcctggacaagttcctgggccaggtggccatcaacctgaacgacatcttcgaggacaagcagagaagaaagaccgagtggttcagactggagagcaagcagggcaagagaatcaagaacagaggcgagatcaaggtgaacatccagttcatgagaaacaacatgaccgccagcatgttcgacctgagcatgaaggacaagaccagaagccccttcgccaagctgaaggacaagatgaagggcagaaagaacgacggcaccttcagcgacaccagcagcgccatcatccccagcacccacatgcccgacgccaacagcgagttcagcagcggcgagatccagatgaagagcaagcccaagaagcccttcctgctgggcccccagagactgagcagcgcccacagcatgagcgacctgagcggcagccacatgagcagcgagaagctgaaggccggcaccatcggccagacccacctgctgggccaccagctggacagcttcggcaccgtgcccgagagcggcagcctgaagagcccccacagaagaaccctgagcttcgacaccagcaagatgaaccagcccgacagcatcgtggacgagggcgagctgtgcttcggcagacagaacgaccccttcaccaacgtgaccgccagcctgccccagaagttcgccaccctgcccagaaagaagaaccccttcgaggagagcagcgagacctgggacagcagcatgaacctgttcagcaagcccatcgagatcagaaaggagaacaagagagagaagagagagaaggtgagcctgttcgagagagtgaccggcaagaaggacagcagaagaagcgacaagctgaacaacggcggcagcgacagcccctgcgacctgaagagccccaacgccttcagcgagaacagacaggactacttcgactacgagagcaccaaccccttcaccgccaagttcagagccagcaacatcatgcccagcagcagcttccacatgagccccaccagcaacgaggacctgagaaagatccccgacagcaaccccttcgacgccaccgccggctacagaagcctgacctacgaggaggtgctgcaggagctggtgaagcacaaggagctgctgagaagaaaggacacccacatcagagagctggaggactacatcgacaacctgctggtgagagtgatggaggagacccccagcatcctgagagtgccctacgagcccagcagaaaggccggcaagttcagcaacagctag

SEQ ID NO: 96033 - DNA, 1599 bp, Artificial Sequence
  Description of Artificial Sequence: Synthetic coding sequence
atgatgctgagcgagcaggcccagaagtggttccccacccacgtgcaggtgaccgtgctgcaggccaaggacctgaagcccaagggcaagagcggcaccaacgacacctacaccatcatccagctgggcaaggagaagtacagcaccagcgtggccgagaagaccctggagcccgtgtggaaggaggaggccagcttcgagctgcccggcctgctgatccagggcagccccgagaagtacatcctgttcctgatcgtgatgcacagaagcctggtgggcctggacaagttcctgggccaggtggccatcaacctgaacgacatcttcgaggacaagcagagaagaaagaccgagtggttcagactggagagcaagcagggcaagagaatcaagaacagaggcgagatcaaggtgaacatccagttcatgagaaacaacatgaccgccagcatgttcgacctgagcatgaaggacaagaccagaagccccttcgccaagctgaaggacaagatgaagggcagaaagaacgacggcaccttcagcgacaccagcagcgccatcatccccagcacccacatgcccgacgccaacagcgagttcagcagcggcgagatccagatgaagagcaagcccaagaagcccttcctgctgggcccccagagactgagcagcgcccacagcatgagcgacctgagcggcagccacatgagcagcgagaagctgaaggccggcaccatcggccagacccacctgctgggccaccagctggacagcttcggcaccgtgcccgagagcggcagcctgaagagcccccacagaagaaccctgagcttcgacaccagcaagatgaaccagcccgacagcatcgtggacgagggcgagctgtgcttcggcagacagaacgaccccttcaccaacgtgaccgccagcctgccccagaagttcgccaccctgcccagaaagaagaaccccttcgaggagagcagcgagacctgggacagcagcatgaacctgttcagcaagcccatcgagatcagaaaggagaacaagagagagaagagagagaaggtgagcctgttcgagagagtgaccggcaagaaggacagcagaagaagcgacaagctgaacaacggcggcagcgacagcccctgcgacctgaagagccccaacgccttcagcgagaacagacaggactacttcgactacgagagcaccaaccccttcaccgccaagttcagagccagcaacatcatgcccagcagcagaaacaccctgctgacccccgccgtggccgagtggagaggcagcctgagatgggccgagctgttccacatgagccccaccagcaacgaggacctgagaaagatccccgacagcaaccccttcgacgccaccgccggctacagaagcctgacctacgaggaggtgctgcaggagctggtgaagcacaaggagctgctgagaagaaaggacacccacatcagagagctggaggactacatcgacaacctgctggtgagagtgatggaggagacccccagcatcctgagagtgccctacgagcccagcagaaaggccggcaagttcagcaacagctag

SEQ ID NO: 96034 - DNA, 2271 bp, Artificial Sequence
  Description of Artificial Sequence: Synthetic coding sequence
atggccagcgccccccccgccagcccccccggcagcgagccccccggccccgaccccgagcccggcggccccgacggccccggcgccgcccagctggcccccggccccgccgagctgagactgggcgcccccgtgggcggccccgacccccagagccccggcctggacgagcccgcccccggcgccgccgccgacggcggcgccagatggagcgccggccccgcccccggcctggagggcggccccagagaccccggccccagcgcccccccccccagaagcggccccagaggccagctggccagccccgacgcccccggccccggccccagaagcgaggcccccctgcccgagctggaccccctgttcagctggaccgaggagcccgaggagtgcggccccgccagctgccccgagagcgcccccttcagactgcagggcagcagcagcagccacagagccagaggcgaggtggacgtgttcagccccttccccgcccccaccgccggcgagctggccctggagcagggccccggcagccccccccagcccagcgacctgagccagacccaccccctgcccagcgagcccgtgggcagccaggaggacggccccagactgagagccgtgttcgacgccctggacggcgacggcgacggcttcgtgagaatcgaggacttcatccagttcgccaccgtgtacggcgccgagcaggtgaaggacctgaccaagtacctggaccccagcggcctgggcgtgatcagcttcgaggacttctaccagggcatcaccgccatcagaaacggcgaccccgacggccagtgctacggcggcgtggccagcgcccaggacgaggagcccctggcctgccccgacgagttcgacgacttcgtgacctacgaggccaacgaggtgaccgacagcgcctacatgggcagcgagagcacctacagcgagtgcgagaccttcaccgacgaggacaccagcaccctggtgcaccccgagctgcagcccgagggcgacgccgacagcgccggcggcagcgccgtgcccagcgagtgcctggacgccatggaggagcccgaccacggcgccctgctgctgctgcccggcagaccccacccccacggccagagcgtgatcaccgtgatcggcggcgaggagcacttcgaggactacggcgagggcagcgaggccgagctgagccccgagaccctgtgcaacggccagctgggctgcagcgaccccgccttcctgacccccagccccaccaagagactgagcagcaagaaggtggccagatacctgcaccagagcggcgccctgaccatggaggccctggaggaccccagccccgagctgatggagggccccgaggaggacatcgccgacaaggtggtgttcctggagagaagagtgctggagctggagaaggacaccgccgccaccggcgagcagcacagcagactgagacaggagaacctgcagctggtgcacagagccaacgccctggaggagcagctgaaggagcaggagctgagagcctgcgagatggtgctggaggagaccagaagacagaaggagctgctgtgcaagatggagagagagaagagcatcgagatcgagaacctgcagaccagactgcagcagctggacgaggagaacagcgagctgagaagctgcaccccctgcctgaaggccaacatcgagagactggaggaggagaagcagaagctgctggacgagatcgagagcctgaccctgagactgagcgaggagcaggagaacaagagaagaatgggcgacagactgagccacgagagacaccagttccagagagacaaggaggccacccaggagctgatcgaggacctgagaaagcagctggagcacctgcagctgctgaagctggaggccgagcagagaagaggcagaagcagcagcatgggcctgcaggagtaccacagcagagccagagagagcgagctggagcaggaggtgagaagactgaagcaggacaacagaaacctgaaggagcagaacgaggagctgaacggccagatcatcaccctgagcatccagggcgccaagagcctgttcagcaccgccttcagcgagagcctggccgccgagatcagcagcgtgagcagagacgagctgatggaggccatccagaagcaggaggagatcaacttcagactgcaggactacatcgacagaatcatcgtggccatcatggagaccaaccccagcatcctggaggtgaagtag

SEQ ID NO: 96035 - DNA, 1383 bp, Artificial Sequence
  Description of Artificial Sequence: Synthetic coding sequence
atgagcctgctgagagccaacgaggtgaccgacagcgcctacatgggcagcgagagcacctacagcgagtgcgagaccttcaccgacgaggacaccagcaccctggtgcaccccgagctgcagcccgagggcgacgccgacagcgccggcggcagcgccgtgcccagcgagtgcctggacgccatggaggagcccgaccacggcgccctgctgctgctgcccggcagaccccacccccacggccagagcgtgatcaccgtgatcggcggcgaggagcacttcgaggactacggcgagggcagcgaggccgagctgagccccgagaccctgtgcaacggccagctgggctgcagcgaccccgccttcctgacccccagccccaccaagagactgagcagcaagaaggtggccagatacctgcaccagagcggcgccctgaccatggaggccctggaggaccccagccccgagctgatggagggccccgaggaggacatcgccgacaaggtggtgttcctggagagaagagtgctggagctggagaaggacaccgccgccaccggcgagcagcacagcagactgagacaggagaacctgcagctggtgcacagagccaacgccctggaggagcagctgaaggagcaggagctgagagcctgcgagatggtgctggaggagaccagaagacagaaggagctgctgtgcaagatggagagagagaagagcatcgagatcgagaacctgcagaccagactgcagcagctggacgaggagaacagcgagctgagaagctgcaccccctgcctgaaggccaacatcgagagactggaggaggagaagcagaagctgctggacgagatcgagagcctgaccctgagactgagcgaggagcaggagaacaagagaagaatgggcgacagactgagccacgagagacaccagttccagagagacaaggaggccacccaggagctgatcgaggacctgagaaagcagctggagcacctgcagctgctgaagctggaggccgagcagagaagaggcagaagcagcagcatgggcctgcaggagtaccacagcagagccagagagagcgagctggagcaggaggtgagaagactgaagcaggacaacagaaacctgaaggagcagaacgaggagctgaacggccagatcatcaccctgagcatccagggcgccaagagcctgttcagcaccgccttcagcgagagcctggccgccgagatcagcagcgtgagcagagacgagctgatggaggccatccagaagcaggaggagatcaacttcagactgcaggactacatcgacagaatcatcgtggccatcatggagaccaaccccagcatcctggaggtgaagtag

SEQ ID NO: 96036 - DNA, 1383 bp, Artificial Sequence
  Description of Artificial Sequence: Synthetic coding sequence
atgcccttcctgaaggccaacgaggtgaccgacagcgcctacatgggcagcgagagcacctacagcgagtgcgagaccttcaccgacgaggacaccagcaccctggtgcaccccgagctgcagcccgagggcgacgccgacagcgccggcggcagcgccgtgcccagcgagtgcctggacgccatggaggagcccgaccacggcgccctgctgctgctgcccggcagaccccacccccacggccagagcgtgatcaccgtgatcggcggcgaggagcacttcgaggactacggcgagggcagcgaggccgagctgagccccgagaccctgtgcaacggccagctgggctgcagcgaccccgccttcctgacccccagccccaccaagagactgagcagcaagaaggtggccagatacctgcaccagagcggcgccctgaccatggaggccctggaggaccccagccccgagctgatggagggccccgaggaggacatcgccgacaaggtggtgttcctggagagaagagtgctggagctggagaaggacaccgccgccaccggcgagcagcacagcagactgagacaggagaacctgcagctggtgcacagagccaacgccctggaggagcagctgaaggagcaggagctgagagcctgcgagatggtgctggaggagaccagaagacagaaggagctgctgtgcaagatggagagagagaagagcatcgagatcgagaacctgcagaccagactgcagcagctggacgaggagaacagcgagctgagaagctgcaccccctgcctgaaggccaacatcgagagactggaggaggagaagcagaagctgctggacgagatcgagagcctgaccctgagactgagcgaggagcaggagaacaagagaagaatgggcgacagactgagccacgagagacaccagttccagagagacaaggaggccacccaggagctgatcgaggacctgagaaagcagctggagcacctgcagctgctgaagctggaggccgagcagagaagaggcagaagcagcagcatgggcctgcaggagtaccacagcagagccagagagagcgagctggagcaggaggtgagaagactgaagcaggacaacagaaacctgaaggagcagaacgaggagctgaacggccagatcatcaccctgagcatccagggcgccaagagcctgttcagcaccgccttcagcgagagcctggccgccgagatcagcagcgtgagcagagacgagctgatggaggccatccagaagcaggaggagatcaacttcagactgcaggactacatcgacagaatcatcgtggccatcatggagaccaaccccagcatcctggaggtgaagtag

SEQ ID NO: 96037 - DNA, 549 bp, Artificial Sequence
  Description of Artificial Sequence: Synthetic coding sequence
atgggcagcgagagcacctacagcgagtgcgagaccttcaccgacgaggacaccagcaccctggtgcaccccgagctgcagcccgagggcgacgccgacagcgccggcggcagcgccgtgcccagcgagtgcctggacgccatggaggagcccgaccacggcgccctgctgctgctgcccggcagaccccacccccacggccagagcgtgatcaccgtgatcggcggcgaggagcacttcgaggactacggcgagggcagcgaggccgagctgagccccgagaccctgtgcaacggccagctgggctgcagcgaccccgccttcctgacccccagccccaccaagagactgagcagcaagaaggtggccagatacctgcaccagagcggcgccctgaccatggaggccctggaggaccccagccccgagctgatggagggccccgaggaggacatcgccgacaaggtggtgttcctggagagaagagtgctggagctggagaaggacaccgccgccaccggcgagcagcacagcagactgagacagtag

SEQ ID NO: 96038 - DNA, 2406 bp, Artificial Sequence
  Description of Artificial Sequence: Synthetic coding sequence
atggccagcgccccccccgccagcccccccggcagcgagccccccggccccgaccccgagcccggcggccccgacggccccggcgccgcccagctggcccccggccccgccgagctgagactgggcgcccccgtgggcggccccgacccccagagccccggcctggacgagcccgcccccggcgccgccgccgacggcggcgccagatggagcgccggccccgcccccggcctggagggcggccccagagaccccggccccagcgcccccccccccagaagcggccccagaggccagctggccagccccgacgcccccggccccggccccagaagcgaggcccccctgcccgagctggaccccctgttcagctggaccgaggagcccgaggagtgcggccccgccagctgccccgagagcgcccccttcagactgcagggcagcagcagcagccacagagccagaggcgaggtggacgtgttcagccccttccccgcccccaccgccggcgagctggccctggagcagggccccggcagccccccccagcccagcgacctgagccagacccaccccctgcccagcgagcccgtgggcagccaggaggacggccccagactgagagccgtgttcgacgccctggacggcgacggcgacggcttcgtgagaatcgaggacttcatccagttcgccaccgtgtacggcgccgagcaggtgaaggacctgaccaagtacctggaccccagcggcctgggcgtgatcagcttcgaggacttctaccagggcatcaccgccatcagaaacggcgaccccgacggccagtgctacggcggcgtggccagcgcccaggacgaggagcccctggcctgccccgacgagttcgacgacttcgtgacctacgaggccaacgaggtgaccgacagcgcctacatgggcagcgagagcacctacagcgagtgcgagaccttcaccgacgaggacaccagcaccctggtgcaccccgagctgcagcccgagggcgacgccgacagcgccggcggcagcgccgtgcccagcgagtgcctggacgccatggaggagcccgaccacggcgccctgctgctgctgcccggcagaccccacccccacggccagagcgtgatcaccgtgatcggcggcgaggagcacttcgaggactacggcgagggcagcgaggccgagctgagccccgagaccctgtgcaacggccagctgggctgcagcgaccccgccttcctgacccccagcaccgaccccctggccgccaagctgcacagcatcctgaccgacgaggccttcgagttctactgcagccagtgccacaagcagatcaacagactggaggacctgagcgccagactgagcgacctggagatgaacagccccaccaagagactgagcagcaagaaggtggccagatacctgcaccagagcggcgccctgaccatggaggccctggaggaccccagccccgagctgatggagggccccgaggaggacatcgccgacaaggtggtgttcctggagagaagagtgctggagctggagaaggacaccgccgccaccggcgagcagcacagcagactgagacaggagaacctgcagctggtgcacagagccaacgccctggaggagcagctgaaggagcaggagctgagagcctgcgagatggtgctggaggagaccagaagacagaaggagctgctgtgcaagatggagagagagaagagcatcgagatcgagaacctgcagaccagactgcagcagctggacgaggagaacagcgagctgagaagctgcaccccctgcctgaaggccaacatcgagagactggaggaggagaagcagaagctgctggacgagatcgagagcctgaccctgagactgagcgaggagcaggagaacaagagaagaatgggcgacagactgagccacgagagacaccagttccagagagacaaggaggccacccaggagctgatcgaggacctgagaaagcagctggagcacctgcagctgctgaagctggaggccgagcagagaagaggcagaagcagcagcatgggcctgcaggagtaccacagcagagccagagagagcgagctggagcaggaggtgagaagactgaagcaggacaacagaaacctgaaggagcagaacgaggagctgaacggccagatcatcaccctgagcatccagggcgccaagagcctgttcagcaccgccttcagcgagagcctggccgccgagatcagcagcgtgagcagagacgagctgatggaggccatccagaagcaggaggagatcaacttcagactgcaggactacatcgacagaatcatcgtggccatcatggagaccaaccccagcatcctggaggtgaagtag

SEQ ID NO: 96039 - DNA, 1914 bp, Artificial Sequence
  Description of Artificial Sequence: Synthetic coding sequence
atggccggcggcgccggctggagcggcgcccccgccgccctgctgagaagcgtgagaagactgagagaggtgttcgaggtgtgcggcagagaccccgacggcttcctgagagtggagagagtggccgccctgggcctgagattcggccagggcgaggaggtggagaagctggtgaagtacctggaccccaacgacctgggcagaatcaacttcaaggacttctgcagaggcgtgttcgccatgaagggctgcgaggagctgctgaaggacgtgctgagcgtggagagcgccggcaccctgccctgcgcccccgagatccccgactgcgtggagcagggcagcgaggtgaccggccccaccttcgccgacggcgagctgatccccagagagcccggcttcttccccgaggacgaggaggaggccatgaccctggccccccccgagggcccccaggagctgtacaccgacagccccatggagagcacccagagcctggagggcagcgtgggcagccccgccgagaaggacggcggcctgggcggcctgttcctgcccgaggacaagagcctggtgcacacccccagcatgaccaccagcgacctgagcacccacagcaccaccagcctgatcagcaacgaggagcagttcgaggactacggcgagggcgacgacgtggactgcgcccccagcagcccctgccccgacgacgagaccagaaccaacgtgtacagcgacctgggcagcagcgtgagcagcagcgccggccagacccccagaaagatgagacacgtgtacaacagcgagctgctggacgtgtactgcagccagtgctgcaagaagatcaacctgctgaacgacctggaggccagactgaagaacctgaaggccaacagccccaacagaaagatcagcagcaccgccttcggcagacagctgatgcacagcagcaacttcagcagcagcaacggcagcaccgaggacctgttcagagacagcatcgacagctgcgacaacgacatcaccgagaaggtgagcttcctggagaagaaggtgaccgagctggagaacgacagcctgaccaacggcgacctgaagagcaagctgaagcaggagaacacccagctggtgcacagagtgcacgagctggaggagatggtgaaggaccaggagaccaccgccgagcaggccctggaggaggaggccagaagacacagagaggcctacggcaagctggagagagagaaggccaccgaggtggagctgctgaacgccagagtgcagcagctggaggaggagaacaccgagctgagaaccaccgtgaccagactgaagagccagaccgagaagctggacgaggagagacagagaatgagcgacagactggaggacaccagcctgagactgaaggacgagatggacctgtacaagagaatgatggacaagctgagacagaacagactggagttccagaaggagagagaggccacccaggagctgatcgaggacctgagaaaggagctggagcacctgcagatgtacaagctggactgcgagagacccggcagaggcagaagcgccagcagcggcctgggcgagttcaacgccagagccagagaggtggagctggagcacgaggtgaagagactgaagcaggagaactacaagctgagagaccagaacgacgacctgaacggccagatcctgagcctgagcctgtacgaggccaagaacctgttcgccgcccagaccaaggcccagagcctggccgccgagatcgacaccgccagcagagacgagctgatggaggccctgaaggagcaggaggagatcaacttcagactgagacagtacatggacaagatcatcctggccatcctggaccacaaccccagcatcctggagatcaagcactag

SEQ ID NO: 96040 - DNA, 1914 bp, Artificial Sequence; identical to SEQ ID NO: 96039
  Description of Artificial Sequence: Synthetic coding sequence

SEQ ID NO: 96041 - DNA, 651 bp, Artificial Sequence
  Description of Artificial Sequence: Synthetic coding sequence
atgggcaccagagacgacgagtacgactacctgttcaaggtggtgctgatcggcgacagcggcgtgggcaagagcaacctgctgagcagattcaccagaaacgagttcaacctggagagcaagagcaccatcggcgtggagttcgccaccagaagcatccaggtggacggcaagaccatcaaggcccagatctgggacaccgccggccaggagagatacagagccatcaccagcgcctactacagaggcgccgtgggcgccctgctggtgtacgacatcgccaagcacctgacctacgagaacgtggagagatggctgaaggagctgagagaccacgccgacagcaacatcgtgatcatgctggtgggcaacaagagcgacctgagacacctgagagccgtgcccaccgacgaggccagagccttcgccgagaagaacggcctgagcttcatcgagaccagcgccctggacagcaccaacgtggaggccgccttccagaccatcctgaccgagatctacagaatcgtgagccagaagcagatgagcgacagaagagagaacgacatgagccccagcaacaacgtggtgcccatccacgtgccccccaccaccgagaacaagcccaaggtgcagtgctgccagaacatctag

SEQ ID NO: 96042 - DNA, 468 bp, Artificial Sequence
  Description of Artificial Sequence: Synthetic coding sequence
atgggcaccagagacgacgagtacgactacctgttcaaggtggtgctgatcggcgacagcggcgtgggcaagagcaacctgctgagcagattcaccagaaacgagttcaacctggagagcaagagcaccatcggcgtggagttcgccaccagaagcatccaggtggacggcaagaccatcaaggcccagatctgggacaccgccggccaggagagatacagagccatcaccagcgcctactacagaggcgccgtgggcgccctgctggtgtacgacatcgccaagcacctgacctacgagaacgtggagagatggctgaaggagctgagagaccacgccgacagcaacatcgtgatcatgctggtgggcaacaagagcgacctgagacacctgagagccgtgcccaccgacgaggccagagccttcgccggctacaacaaggccaacgtgagacagaccagaaagtag

SEQ ID NO: 96043 - DNA, 612 bp, Artificial Sequence
  Description of Artificial Sequence: Synthetic coding sequence
atggccaaggcctacgaccacctgttcaagctgctgctgatcggcgacagcggcgtgggcaagacctgcctgatcatcagattcgccgaggacaacttcaacaacacctacatcagcaccatcggcatcgacttcaagatcagaaccgtggacatcgagggcaagaagatcaagctgcaggtgtgggacaccgccggccaggagagattcaagaccatcaccaccgcctactacagaggcgccatgggcatcatcctggtgtacgacatcaccgacgagaagagcttcgagaacatccagaactggatgaagagcatcaaggagaacgccagcgccggcgtggagagactgctgctgggcaacaagtgcgacatggaggccaagagaaaggtgcagaaggagcaggccgacaagctggccagagagcacggcatcagattcttcgagaccagcgccaagagcagcatgaacgtggacgaggccttcagcagcctggccagagacatcctgctgaagagcggcggcagaagaagcggcaacggcaacaagccccccagcaccgacctgaagacctgcgacaagaagaacaccaacaagtgcagcctgggctag

SEQ ID NO: 96044 - DNA, 648 bp, Artificial Sequence
  Description of Artificial Sequence: Synthetic coding sequence
atggccaccgccccctacaactacagctacatcttcaagtacatcatcatcggcgacatgggcgtgggcaagagctgcctgctgcaccagttcaccgagaagaagttcatggccgactgcccccacaccatcggcgtggagttcggcaccagaatcatcgaggtgagcggccagaagatcaagctgcagatctgggacaccgccggccaggagagattcagagccgtgaccagaagctactacagaggcgccgccggcgccctgatggtgtacgacatcaccagaagaagcacctacaaccacctgagcagctggctgaccgacgccagaaacctgaccaaccccaacaccgtgatcatcctgatcggcaacaaggccgacctggaggcccagagagacgtgacctacgaggaggccaagcagttcgccgaggagaacggcctgctgttcctggaggccagcgccaagaccggcgagaacgtggaggacgccttcctggaggccgccaagaagatctaccagaacatccaggacggcagcctggacctgaacgccgccgagagcggcgtgcagcacaagcccagcgccccccagggcggcagactgaccagcgagccccagccccagagagagggctgcggctgctag

SEQ ID NO: 96045 - DNA, 546 bp, Artificial Sequence
  Description of Artificial Sequence: Synthetic coding sequence
atggccaccgccccctacaactacagctacatcttcaagtacatcatcatcggcgacatgggcgtgggcaagagctgcctgctgcaccagttcaccgagaagaagttcatggccgactgcccccacaccatcggcgtggagttcggcaccagaatcatcgaggtgagcggccagaagatcaagctgcagatctgggacaccgccggccaggagagattcagagccgtgaccagaagctactacagaggcgccgccggcgccctgatggtgtacgacatcaccagaagaagcacctacaaccacctgagcagctggctgaccgacgccagaaacctgaccaaccccaacaccgtgatcatcctgatcggcaacaaggccgacctggaggcccagagagacgtgacctacgaggaggccaagcagttcgccgaggagaacggcctgctgttcctggaggccagcgccaagaccggcgagaacgtggaggacgccttcctggaggccgccaagaagatctaccagaacatccaggacggcagcctgtag

SEQ ID NO: 96046 - DNA, 711 bp, Artificial Sequence
  Description of Artificial Sequence: Synthetic coding sequence
atgggccagaaggccagccagcagctggccctgaaggacagcaaggaggtgcccgtggtgtgcgaggtggtgagcgaggccatcgtgcacgccgcccagaagctgaaggagtacctgggcttcgagtacccccccagcaagctgtgccccgccgccaacaccctgaacgagatcttcctgatccacttcatcaccttctgccaggagaagggcgtggacgagtggctgaccaccaccaagatgaccaagcaccaggccttcctgttcggcgccgactggatctggaccttctggggcagcaacaagcagatcaagctgcagctggccgtgcagaccctgcagatgagcagccccccccccgtggagagcaagccctgcgacctgagcaaccccgagagcagagtggaggagagcagctggaagaagagcagattcgacaagctggaggagttctgcaacctgatcggcgaggactgcctgggcctgttcatcatcttcggcatgcccggcaagcccaaggacatcagaggcgtggtgctggacagcgtgaagagccagatggtgagaagccacctgcccggcggcaaggccgtggcccagttcgtgctggagaccgaggactgcgtgttcatcaaggagctgctgagaaactgcctgagcaagaaggacggcctgagagaggtgggcaaggtgtacatcagcatcctgtag

SEQ ID NO: 96047 - DNA, 639 bp, Artificial Sequence
  Description of Artificial Sequence: Synthetic coding sequence
atggcccaggcccacagaaccccccagcccagagccgcccccagccagcccagagtgttcaagctggtgctgctgggcagcggcagcgtgggcaagagcagcctggccctgagatacgtgaagaacgacttcaagagcatcctgcccaccgtgggctgcgccttcttcaccaaggtggtggacgtgggcgccaccagcctgaagctggagatctgggacaccgccggccaggagaagtaccacagcgtgtgccacctgtacttcagaggcgccaacgccgccctgctggtgtacgacatcaccagaaaggacagcttcctgaaggcccagcagtggctgaaggacctggaggaggagctgcaccccggcgaggtgctggtgatgctggtgggcaacaagaccgacctgagccaggagagagaggtgaccttccaggagggcaaggagttcgccgacagccagaagctgctgttcatggagaccagcgccaagctgaaccaccaggtgagcgaggtgttcaacaccgtggcccaggagctgctgcagagaagcgacgaggagggccaggccctgagaggcgacgccgccgtggccctgaacaagggccccgccagacaggccaagtgctgcgcccactag

SEQ ID NO: 96048 - DNA, 258 bp, Artificial Sequence
  Description of Artificial Sequence: Synthetic coding sequence
atgctggtgggcaacaagaccgacctgagccaggagagagaggtgaccttccaggagggcaaggagttcgccgacagccagaagctgctgttcatggagaccagcgccaagctgaaccaccaggtgagcgaggtgttcaacaccgtggcccaggagctgctgcagagaagcgacgaggagggccaggccctgagaggcgacgccgccgtggccctgaacaagggccccgccagacaggccaagtgctgcgcccactag

SEQ ID NO: 96049 - DNA, 621 bp, Artificial Sequence
  Description of Artificial Sequence: Synthetic coding sequence
atggacgaggacgtgctgaccaccctgaagatcctgatcatcggcgagagcggcgtgggcaagagcagcctgctgctgagattcaccgacgacaccttcgaccccgagctggccgccaccatcggcgtggacttcaaggtgaagaccatcagcgtggacggcaacaaggccaagctggccatctgggacaccgccggccaggagagattcagaaccctgacccccagctactacagaggcgcccagggcgtgatcctggtgtacgacgtgaccagaagagacaccttcgtgaagctggacaactggctgaacgagctggagacctactgcaccagaaacgacatcgtgaacatgctggtgggcaacaagatcgacaaggagaacagagaggtggacagaaacgagggcctgaagttcgccagaaagcacagcatgctgttcatcgaggccagcgccaagacctgcgacggcgtgcagtgcgccttcgaggagctggtggagaagatcatccagacccccggcctgtgggagagcgagaaccagaacaagggcgtgaagctgagccacagagaggagggccagggcggcggcgcctgcggcggctactgcagcgtgctgtag

SEQ ID NO: 96050 - DNA, 486 bp, Artificial Sequence
  Description of Artificial Sequence: Synthetic coding sequence
atggacgaggacgtgctgaccaccctgaagatcctgatcatcggcgagagcggcgtgggcaagagcagcctgctgctgagattcaccgacgacaccttcgaccccgagctggccgccaccatcgtgtacgacgtgaccagaagagacaccttcgtgaagctggacaactggctgaacgagctggagacctactgcaccagaaacgacatcgtgaacatgctggtgggcaacaagatcgacaaggagaacagagaggtggacagaaacgagggcctgaagttcgccagaaagcacagcatgctgttcatcgaggccagcgccaagacctgcgacggcgtgcagtgcgccttcgaggagctggtggagaagatcatccagacccccggcctgtgggagagcgagaaccagaacaagggcgtgaagctgagccacagagaggagggccagggcggcggcgcctgcggcggctactgcagcgtgctgtag

SEQ ID NO: 96051 - DNA, 876 bp, Artificial Sequence
  Description of Artificial Sequence: Synthetic coding sequence
tgaagactgcccggcagcagacccctgcccggccccagcagcctgggcagaagccccagctgcagcgccgagaagacccccttcagaggcccccccctgggcagacagagcgccgtgaaggagctggacctggtgaccgccggcaagttcagattcagcgtgagaagcgagtgcttcagcagaggcccccccctgaagatcaagtgcaactgctacttcagcttctgccacatcctgtggagacagaagatcagcgtggtgctgagcttcttcaccttcagcctgggcaagatcatcctgaccgtggagctgagcatcagcctgctgctgagattcaccgacgacaccttcgaccccgagctggccgccaccatcggcgtggacttcaaggtgaagaccatcagcgtggacggcaacaaggccaagctggccatctgggtgaccctgcaccagcagaccgccaacttcttcctgaagagccagatcggcaacagccccatcctgaagtgggccatgtggcagtacgacaccgccggccaggagagattcagaaccctgacccccagctactacagaggcgcccagggcgtgatcctggtgtacgacgtgaccagaagagacaccttcgtgaagctggacaactggctgaacgagctggagacctactgcaccagaaacgacatcgtgaacatgctggtgggcaacaagatcgacaaggagaacagagaggtggacagaaacgagggcctgaagttcgccagaaagcacagcatgctgttcatcgaggccagcgccaagacctgcgacggcgtgcagtgcgccttcgaggagctggtggagaagatcatccagacccccggcctgtgggagagctag

SEQ ID NO: 96052 - DNA, 429 bp, Artificial Sequence
  Description of Artificial Sequence: Synthetic coding sequence
atggacgaggacgtgctgaccaccctgaagatcctgatcatcggcgagagcggcgtgggcaagagcagcctgctgctgagattcaccgacgacaccttcgaccccgagctggccgccaccatcggcgtggacttcaaggtgaagaccatcagcgtggacggcaacaaggccaagctggccatctgggagaacagagaggtggacagaaacgagggcctgaagttcgccagaaagcacagcatgctgttcatcgaggccagcgccaagacctgcgacggcgtgcagtgcgccttcgaggagctggtggagaagatcatccagacccccggcctgtgggagagcgagaaccagaacaagggcgtgaagctgagccacagagaggagggccagggcggcggcgcctgcggcggctactgcagcgtgctgtag

SEQ ID NO: 96053 - DNA, 555 bp, Artificial Sequence
  Description of Artificial Sequence: Synthetic coding sequence
atggacgaggacgtgctgaccaccctgaagatcctgatcatcggcgagagcggcgtgggcaagagcagcctgctgctgagattcaccgacgacaccttcgaccccgagctggccgccaccgacaccgccggccaggagagattcagaaccctgacccccagctactacagaggcgcccagggcgtgatcctggtgtacgacgtgaccagaagagacaccttcgtgaagctggacaactggctgaacgagctggagacctactgcaccagaaacgacatcgtgaacatgctggtgggcaacaagatcgacaaggagaacagagaggtggacagaaacgagggcctgaagttcgccagaaagcacagcatgctgttcatcgaggccagcgccaagacctgcgacggcgtgcagtgcgccttcgaggagctggtggagaagatcatccagacccccggcctgtgggagagcgagaaccagaacaagggcgtgaagctgagccacagagaggagggccagggcggcggcgcctgcggcggctactgcagcgtgctgtag

SEQ ID NO: 96054 - DNA, 390 bp, Artificial Sequence
  Description of Artificial Sequence: Synthetic coding sequence
atgagcagcatgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatcgagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96055 - DNA, 390 bp, Artificial Sequence
  Description of Artificial Sequence: Synthetic coding sequence
atgagctgcctgcaccccaccagcgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatcgagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96056 - DNA, 522 bp, Artificial Sequence
  Description of Artificial Sequence: Synthetic coding sequence
atgagcagcatgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatcgagagcttcaacaacgtgaagcagtggctgcaggagatcgacagatacgccagcgagaacgtgaacaagctgctggtgggcaacaagtgcgacctgaccaccaagaaggtggtggactacaccaccgccaaggagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96057 - DNA, 522 bp, Artificial Sequence
  Description of Artificial Sequence: Synthetic coding sequence
atgagcagcatgaaccccgagtacgactacctgttcaagctgctgctgatcggcgacagcggcgtgggcaagagctgcctgctgctgagattcgcctgggacaccgccggccaggagagattcagaaccatcaccagcagctactacagaggcgcccacggcatcatcgtggtgtacgacgtgaccgaccaggagagcttcaacaacgtgaagcagtggctgcaggagatcgacagatacgccagcgagaacgtgaacaagctgctggtgggcaacaagtgcgacctgaccaccaagaaggtggtggactacaccaccgccaaggagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96058 - DNA, 618 bp, Artificial Sequence
  Description of Artificial Sequence: Synthetic coding sequence
atgagcagcatgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatctgggacaccgccggccaggagagattcagaaccatcaccagcagctactacagaggcgcccacggcatcatcgtggtgtacgacgtgaccgaccaggagagcttcaacaacgtgaagcagtggctgcaggagatcgacagatacgccagcgagaacgtgaacaagctgctggtgggcaacaagtgcgacctgaccaccaagaaggtggtggactacaccaccgccaaggagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96059 - DNA, 426 bp, Artificial Sequence
  Description of Artificial Sequence: Synthetic coding sequence
atgagcagcatgaaccccgagtacgactacctgttcaagctgctgctgatcggcgacagcggcgtgggcaagagctgcctgctgctgagattcgccgagagcttcaacaacgtgaagcagtggctgcaggagatcgacagatacgccagcgagaacgtgaacaagctgctggtgggcaacaagtgcgacctgaccaccaagaaggtggtggactacaccaccgccaaggagttcgccgacagcctgggcatccccttcctggagaccagcgccaagaacgccaccaacgtggagcagagcttcatgaccatggccgccgagatcaagaagagaatgggccccggcgccaccgccggcggcgccgagaagagcaacgtgaagatccagagcacccccgtgaagcagagcggcggcggctgctgctag

SEQ ID NO: 96060 - DNA, 606 bp, Artificial Sequence
  Description of Artificial Sequence: Synthetic coding sequence
atgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatctgggacaccgccggccaggagagattcagaaccatcaccagcagctactacagaggcgcccacggcatcatcgtggtgtacgacgtgaccgaccaggagagctacgccaacgtgaagcagtggctgcaggagatcgacagatacgccagcgagaacgtgaacaagctgctggtgggcaacaagagcgacctgaccaccaagaaggtggtggacaacaccaccgccaaggagttcgccgacagcctgggcatccccttcctggagaccagcgccaagaacgccaccaacgtggagcaggccttcatgaccatggccgccgagatcaagaagagaatgggccccggcgccgccagcggcggcgagagacccaacctgaagatcgacagcacccccgtgaagcccgccggcggcggctgctgctag

SEQ ID NO: 96061 - DNA, 489 bp, Artificial Sequence
  Description of Artificial Sequence: Synthetic coding sequence
atgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatctgggacaccgccggccaggagagattcagaaccatcaccagcagctactacagaggcgcccacggcatcatcgtggtgtacgacgtgaccgaccaggagagctacgccaacgtgaagcagggctgcagaagactgaccgccatgcccgccagaaccagcatcagcagctggtgggccaccagagccaccagcccccccagaagatggtggaccaccccccagcccagaagcctgcagaccctgtgggccagccccagctggagaagagcccccagaatgccccccatgagcagcagaagaagctag

SEQ ID NO: 96062 - DNA, 360 bp, Artificial Sequence
  Description of Artificial Sequence: Synthetic coding sequence
atgaaccccgagtacgactacctgttcaagctgctgctgatcggcgacagcggcgtgggcaagagctgcctgctgctgagattcgccgacgacacctacaccgagagctacatcagcaccatcggcgtggacttcaagatcagaaccatcgagctggacggcaagaccatcaagctgcagatctgggacaccgccggccaggagagattcagaaccatcaccagcagctactacagaggcgcccacggcatcatcgtggtgtacgacgtgaccgaccaggagagctacgccaacgtgaagcagtggctgcaggagatcgacagatacgccagcgagaacgtgaacaagctgctggtgtag

SEQ ID NO: 96063 - DNA, 678 bp, Artificial Sequence
  Description of Artificial Sequence: Synthetic coding sequence
atggccgccgccggcggcggcggcggcggcgccgccgccgccggcagagcctacagcttcaaggtggtgctgctgggcgagggctgcgtgggcaagaccagcctggtgctgagatactgcgagaacaagttcaacgacaagcacatcaccaccctgcaggccagcttcctgaccaagaagctgaacatcggcggcaagagagtgaacctggccatctgggacaccgccggccaggagagattccacgccctgggccccatctactacagagacagcaacggcgccatcctggtgtacgacatcaccgacgaggacagcttccagaaggtgaagaactgggtgaaggagctgagaaagatgctgggcaacgagatctgcctgtgcatcgtgggcaacaagatcgacctggagaaggagagacacgtgagcatccaggaggccgagagctacgccgagagcgtgggcgccaagcactaccacaccagcgccaagcagaacaagggcatcgaggagctgttcctggacctgtgcaagagaatgatcgagaccgcccaggtggacgagagagccaagggcaacggcagcagccagcccggcaccgccagaagaggcgtgcagatcatcgacgacgagccccaggcccagaccagcggcggcggctgctgcagcagcggctag

SEQ ID NO: 96064 - DNA, 585 bp, Artificial Sequence
  Description of Artificial Sequence: Synthetic coding sequence
atggccctgagagagctgaaggtgtgcctgctgggcgacaccggcgtgggcaagagcagcatcgtgtggagattcgtggaggacagcttcgaccccaacatcaaccccaccatcggcgccagcttcatgaccaagaccgtgcagtaccagaacgagctgcacaagttcctgatctgggacaccgccggccaggagagattcagagccctggcccccatgtactacagaggcagcgccgccgccatcatcgtgtacgacatcaccaaggaggagaccttcagcaccctgaagaactgggtgaaggagctgagacagcacggcccccccaacatcgtggtggccatcgccggcaacaagtgcgacctgatcgacgtgagagaggtgatggagagagacgccaaggactacgccgacagcatccacgccatcttcgtggagaccagcgccaagaacgccatcaacatcaacgagctgttcatcgagatcagcagaagaatccccagcaccgacgccaacctgcccagcggcggcaagggcttcaagctgagaagacagcccagcgagcccaagagaagctgctgctag

SEQ ID NO: 96065 - DNA, 714 bp, Artificial Sequence
  Description of Artificial Sequence: Synthetic coding sequence
atgctggaggaggacatggaggtggccatcaagatggtggtggtgggcaacggcgccgtgggcaagagcagcatgatccagagatactgcaagggcatcttcaccaaggactacaagaagaccatcggcgtggacttcctggagagacagatccaggtgaacgacgaggacgtgagactgatgctgtgggacaccgccggccaggaggagttcgacgccatcaccaaggcctactacagaggcgcccaggcctgcgtgctggtgttcagcaccaccgacagagagagcttcgaggccgtgagcagctggagagagaaggtggtggccgaggtgggcgacatccccaccgtgctggtgcagaacaagatcgacctgctggacgacagctgcatcaagaacgaggaggccgaggccctggccaagagactgaagctgagattctacagaaccagcgtgaaggaggacctgaacgtgaacgaggtgttcaagtacctggccgagaagtacctgcagaagctgaagcagcagatcgccgaggaccccgagctgacccacagcagcagcaacaagatcggcgtgttcaacaccagcggcggcagccacagcggccagaacagcggcaccctgaacggcggcgacgtgatcaacctgagacccaacaagcagagaaccaagaagaacagaaaccccttcagcagctgcagcatcccctag

SEQ ID NO: 96066 - DNA, 714 bp, Artificial Sequence; identical to SEQ ID NO: 96065
  Description of Artificial Sequence: Synthetic coding sequence

SEQ ID NO: 96067 - DNA, 612 bp, Artificial Sequence
  Description of Artificial Sequence: Synthetic coding sequence
atgagcggccagagagtggacgtgaaggtggtgatgctgggcaaggagtacgtgggcaagaccagcctggtggagagatacgtgcacgacagattcctggtgggcccctaccagaacaccatcggcgccgccttcgtggccaaggtgatgagcgtgggcgacagaaccgtgaccctgggcatctgggacaccgccggcagcgagagatacgaggccatgagcagaatctactacagaggcgccaaggccgccatcgtgtgctacgacctgaccgacagcagcagcttcgagagagccaagttctgggtgaaggagctgagaagcctggaggagggctgccagatctacctgtgcggcaccaagagcgacctgctggaggaggacagaagaagaagaagagtggacttccacgacgtgcaggactacgccgacaacatcaaggcccagctgttcgagaccagcagcaagaccggccagagcgtggacgagctgttccagaaggtggccgaggactacgtgagcgtggccgccttccaggtgatgaccgaggacaagggcgtggacctgggccagaagcccaacccctacttctacagctgctgccaccactag

SEQ ID NO: 96068 - DNA, 612 bp, Artificial Sequence; identical to SEQ ID NO: 96067
  Description of Artificial Sequence: Synthetic coding sequence

SEQ ID NO: 96069 - DNA, 201 bp, Artificial Sequence
  Description of Artificial Sequence: Synthetic coding sequence
atgagcggccagagagtggacgtgaaggtggtgatgctgggcaaggagtacgtgggcaagaccagcctggtggagagatacgtgcacgacagattcctggtgggcccctaccagaacaccatcggcgccgccttcgtggccaaggtgatgagcgtgggcgacagaaccgtgaccctgggcatctgggacaccgccggctag

SEQ ID NO: 96070 - DNA, 642 bp, Artificial Sequence
  Description of Artificial Sequence: Synthetic coding sequence
atgggcaacggcaccgaggaggactacaacttcgtgttcaaggtggtgctgatcggcgagagcggcgtgggcaagaccaacctgctgagcagattcaccagaaacgagttcagccacgacagcagaaccaccatcggcgtggagttcagcaccagaaccgtgatgctgggcaccgccgccgtgaaggcccagatctgggacaccgccggcctggagagatacagagccatcaccagcgcctactacagaggcgccgtgggcgccctgctggtgttcgacctgaccaagcaccagacctacgccgtggtggagagatggctgaaggagctgtacgaccacgccgaggccaccatcgtggtgatgctggtgggcaacaagagcgacctgagccaggccagagaggtgcccaccgaggaggccagaatgttcgccgagaacaacggcctgctgttcctggagaccagcgccctggacagcaccaacgtggagctggccttcgagaccgtgctgaaggagatcttcgccaaggtgagcaagcagagacagaacagcatcagaaccaacgccatcaccctgggcagcgcccaggccggccaggagcccggccccggcgagaagagagcctgctgcatcagcctgtag

SEQ ID NO: 96071 - DNA, 1110 bp, Artificial Sequence
  Description of Artificial Sequence: Synthetic coding sequence
atggagggcagcctggagagagaggcccccgccggcgccctggccgccgtgctgaagcacagcagcaccctgccccccgagagcacccaggtgagaggctacgacttcaacagaggcgtgaactacagagccctgctggaggccttcggcaccaccggcttccaggccaccaacttcggcagagccgtgcagcaggtgaacgccatgatcgagaagaagctggagcccctgagccaggacgaggaccagcacgccgacctgacccagagcagaagacccctgaccagctgcaccatcttcctgggctacaccagcaacctgatcagcagcggcatcagagagaccatcagatacctggtgcagcacaacatggtggacgtgctggtgaccaccgccggcggcgtggaggaggacctgatcaagtgcctggcccccacctacctgggcgagttcagcctgagaggcaaggagctgagagagaacggcatcaacagaatcggcaacctgctggtgcccaacgagaactactgcaagttcgaggactggctgatgcccatcctggaccagatggtgatggagcagaacaccgagggcgtgaagtggacccccagcaagatgatcgccagactgggcaaggagatcaacaaccccgagagcgtgtactactgggcccagaagaaccacatccccgtgttcagccccgccctgaccgacggcagcctgggcgacatgatcttcttccacagctacaagaaccccggcctggtgctggacatcgtggaggacctgagactgatcaacacccaggccatcttcgccaagtgcaccggcatgatcatcctgggcggcggcgtggtgaagcaccacatcgccaacgccaacctgatgagaaacggcgccgactacgccgtgtacatcaacaccgcccaggagttcgacggcagcgacagcggcgccagacccgacgaggccgtgagctggggcaagatcagagtggacgcccagcccgtgaaggtgtacgccgacgccagcctggtgttccccctgctggtggccgagaccttcgcccagaagatggacgccttcatgcacgagaagaacgaggactag

SEQ ID NO: 96072 - DNA, 573 bp, Artificial Sequence
  Description of Artificial Sequence: Synthetic coding sequence
atgctggtgggcgacagcggcgtgggcaagacctgcctgctggtgagattcaaggacggcgccttcctggccggcaccttcatcagcaccgtgggcatcgacttcagaaacaaggtgctggacgtggacggcgtgaaggtgaagctgcagatgtgggacaccgccggccaggagagattcagaagcgtgacccacgcctactacagagacgcccacgccctgctgctgctgtacgacgtgaccaacaaggccagcttcgacaacatccaggcctggctgaccgagatccacgagtacgcccagcacgacgtggccctgatgctgctgggcaacaaggtggacagcgcccacgagagagtggtgaagagagaggacggcgagaagctggccaaggagtacggcctgcccttcatggagaccagcgccaagaccggcctgaacgtggacctggccttcaccgccatcgccaaggagctgaagcagagaagcatgaaggcccccagcgagcccagattcagactgcacgactacgtgaagagagagggcagaggcgccagctgctgcagaccctag

SEQ ID NO: 96073 - DNA, 666 bp, Artificial Sequence
  Description of Artificial Sequence: Synthetic coding sequence
atgagcgacggcgactacgactacctgatcaagttcctggccctgggcgacagcggcgtgggcaagaccagcgtgctgtaccagtacaccgacggcaagttcaacagcaagttcatcaccaccgtgggcatcgacttcagagagaagagagtggtgtacagagccagcggccccgacggcgccaccggcagaggccagagaatccacctgcagctgtgggacaccgccggccaggagagattcagaagcctgaccaccgccttcttcagagacgccatgggcttcctgctgctgttcgacctgaccaacgagcagagcttcctgaacgtgagaaactggatcagccagctgcagatgcacgcctactgcgagaaccccgacatcgtgctgtgcggcaacaagagcgacctggaggaccagagagtggtgaaggaggaggaggccatcgccctggccgagaagtacggcatcccctacttcgagaccagcgccgccaacggcaccaacatcagccaggccatcgagatgctgctggacctgatcatgaagagaatggagagatgcgtggacaagagctggatccccgagggcgtggtgagaagcaacggccacgccagcaccgaccagctgagcgaggagaaggagaagggcgcctgcggctgctag

SEQ ID NO: 96074 - DNA, 642 bp, Artificial Sequence
  Description of Artificial Sequence: Synthetic coding sequence
atgagcgacggcgactacgactacctgatcaagttcctggccctgggcgacagcggcgtgggcaagaccagcgtgctgtaccagtacaccgacggcaagttcaacagcaagttcatcaccaccgtgggcatcgacttcagagagaagagagtggtgtacagagccagcggccccgacggcgccaccggcagaggccagagaatccacctgcagctgtgggacaccgccggccaggagagattcagaagcctgaccaccgccttcttcagagacgccatgggcttcctgctgctgttcgacctgaccaacgagcagagcttcctgaacgtgagaaactggatcagccagctgcagatgcacgcctactgcgagaaccccgacatcgtgctgtgcggcaacaagagcgacctggaggaccagagagtggtgaaggagaagtacggcatcccctacttcgagaccagcgccgccaacggcaccaacatcagccaggccatcgagatgctgctggacctgatcatgaagagaatggagagatgcgtggacaagagctggatccccgagggcgtggtgagaagcaacggccacgccagcaccgaccagctgagcgaggagaaggagaagggcgcctgcggctgctag

SEQ ID NO: 96075 - DNA, 666 bp, Artificial Sequence; identical to SEQ ID NO: 96073
  Description of Artificial Sequence: Synthetic coding sequence

SEQ ID NO: 96076 - DNA, 663 bp, Artificial Sequence
  Description of Artificial Sequence: Synthetic coding sequence
atgagcgacagcgaggaggagagccaggacagacagctgaagatcgtggtgctgggcgacggcgccagcggcaagaccagcctgaccacctgcttcgcccaggagaccttcggcaagcagtacaagcagaccatcggcctggacttcttcctgagaagaatcaccctgcccggcaacctgaacgtgaccctgcagatctgggacatcggcggccagaccatcggcggcaagatgctggacaagtacatctacggcgcccagggcgtgctgctggtgtacgacatcaccaactaccagagcttcgagaacctggaggactggtacaccgtggtgaagaaggtgagcgaggagagcgagacccagcccctggtggccctggtgggcaacaagatcgacctggagcacatgagaaccatcaagcccgagaagcacctgagattctgccaggagaacggcttcagcagccacttcgtgagcgccaagaccggcgacagcgtgttcctgtgcttccagaaggtggccgccgagatcctgggcatcaagctgaacaaggccgagatcgagcagagccagagaatcgtgagagccgagatcgtgaagtaccccgaggaggagaaccagcacaccaccagcacccagagcagaatctgcagcgtgcagtag

SEQ ID NO: 96077 - DNA, 666 bp, Artificial Sequence
  Description of Artificial Sequence: Synthetic coding sequence
atgagcgacagcgaggaggagagccaggacagacagctgaagatcgtggtgctgggcgacggcgccagcggcaagaccagcctgaccacctgcttcgcccaggagaccttcggcaagcagtacaagcagaccatcggcctggacttcttcctgagaagaatcaccctgcccggcaacctgaacgtgaccctgcagatctgggacatcggcggccagaccatcggcggcaagatgctggacaagtacatctacggcgcccagggcgtgctgctggtgtacgacatcaccaactaccagagcttcgagaacctggaggactggtacaccgtggtgaagaaggtgagcgaggagagcgagacccagcccctggtggccctggtgggcaacaagatcgacctggagcacatgagaaccatcaagcccgagaagcacctgagattctgccaggagaacggcttcagcagccacttcgtgagcgccaagaccggcgacagcgtgttcctgtgcttccagaaggtggccgccgagatcctgggcatcaagctgaacaaggccgagatcgagcagagccagagagtggtgaaggccgacatcgtgaactacaaccaggagcccatgagcagaaccgtgaacccccccagaagcagcatgtgcgccgtgcagtag

SEQ ID NO: 96078 - DNA, 615 bp, Artificial Sequence
  Description of Artificial Sequence: Synthetic coding sequence
atgagcgacagcgaggaggagagccaggacagacagctgaagatcgtggtgctgggcgacggcgccagcggcaagaccagcctgaccacctgcttcgcccaggagaccttcggcaagcagtacaagcagaccatcggcctggacttcttcctgagaagaatcaccctgcccggcaacctgaacgtgaccctgcagatctgggacatcggcggccagaccatcggcggcaagatgctggacaagtacatctacggcgcccagggcgtgctgctggtgtacgacatcaccaactaccagagcttcgagaacctggaggactggtacaccgtggtgaagaaggtgagcgaggagagcgagacccagcccctggtggccctggtgggcaacaagatcgacctggagcacatgagaaccatcaagcccgagaagcacctgagattctgccaggagaacggcttcagcagccacttcgtgagcgccaagaccggcgacagcgtgttcctgtgcttccagaaggtggccgccgagatcctgggcatcaagctgaacaaggccgagatcgagcagagccagggccacttcatcatcttcatcagcagcaccaacagagagtag

SEQ ID NO: 96079 - DNA, 288 bp, Artificial Sequence
  Description of Artificial Sequence: Synthetic coding sequence
atgagcgacagcgaggaggagagccaggacagacagctgaagatcgtggtgctgggcgacggcgccagcggcaagaccagcctgaccacctgcttcgcccaggagaccttcggcaagcagtacaagcagaccatcggcctggacttcttcctgagaagaatcaccctgcccggcaacctgaacgtgaccctgcagatctgggacatcggcggccagaccatcggcggcaagatgctggacaagtacatctacggcgcccagctgatctggagcatctgcgagcagtag

SEQ ID NO: 96080 - DNA, 639 bp, Artificial Sequence
  Description of Artificial Sequence: Synthetic coding sequence
atggcctacgcctacctgttcaagtacatcatcatcggcgacaccggcgtgggcaagagctgcctgctgctgcagttcaccgacaagagattccagcccgtgcacgacctgaccatcggcgtggagttcggcgccagaatgatcaccatcgacggcaagcagatcaagctgcagatctgggacaccgccggccaggagagcttcagaagcatcaccagaagctactacagaggcgccgccggcgccctgctggtgtacgacatcaccagaagagacaccttcaaccacctgaccacctggctggaggacgccagacagcacagcaacagcaacatggtgatcatgctgatcggcaacaagagcgacctggagagcagaagagaggtgaagaaggaggagggcgaggccttcgccagagagcacggcctgatcttcatggagaccagcgccaagaccgccagcaacgtggaggaggccttcatcaacaccgccaaggagatctacgagaagatccaggagggcgtgttcgacatcaacaacgaggccaacggcatcaagatcggcccccagcacgccgccaccaacgccacccacgccggcaaccagggcggccagcaggccggcggcggctgctgctag

SEQ ID NO: 96081 - DNA, 567 bp, Artificial Sequence
  Description of Artificial Sequence: Synthetic coding sequence
atggcctacgcctacctgttcaagtacatcatcatcggcgacaccggcgtggagttcggcgccagaatgatcaccatcgacggcaagcagatcaagctgcagatctgggacaccgccggccaggagagcttcagaagcatcaccagaagctactacagaggcgccgccggcgccctgctggtgtacgacatcaccagaagagacaccttcaaccacctgaccacctggctggaggacgccagacagcacagcaacagcaacatggtgatcatgctgatcggcaacaagagcgacctggagagcagaagagaggtgaagaaggaggagggcgaggccttcgccagagagcacggcctgatcttcatggagaccagcgccaagaccgccagcaacgtggaggaggccttcatcaacaccgccaaggagatctacgagaagatccaggagggcgtgttcgacatcaacaacgaggccaacggcatcaagatcggcccccagcacgccgccaccaacgccacccacgccggcaaccagggcggccagcaggccggcggcggctgctgctag

SEQ ID NO: 96082 - DNA, 501 bp, Artificial Sequence
  Description of Artificial Sequence: Synthetic coding sequence
atgatcaccatcgacggcaagcagatcaagctgcagatctgggacaccgccggccaggagagcttcagaagcatcaccagaagctactacagaggcgccgccggcgccctgctggtgtacgacatcaccagaagagacaccttcaaccacctgaccacctggctggaggacgccagacagcacagcaacagcaacatggtgatcatgctgatcggcaacaagagcgacctggagagcagaagagaggtgaagaaggaggagggcgaggccttcgccagagagcacggcctgatcttcatggagaccagcgccaagaccgccagcaacgtggaggaggccttcatcaacaccgccaaggagatctacgagaagatccaggagggcgtgttcgacatcaacaacgaggccaacggcatcaagatcggcccccagcacgccgccaccaacgccacccacgccggcaaccagggcggccagcaggccggcggcggctgctgctag

SEQ ID NO: 96083 - DNA, 630 bp, Artificial Sequence
  Description of Artificial Sequence: Synthetic coding sequence
atgacctacgcctacctgttcaagtacatcatcatcggcgacaccggcgtgggcaagagctgcctgctgctgcagttcaccgacaagagattccagcccgtgcacgacctgaccatcggcgtggagttcggcgccagaatggtgaacatcgacggcaagcagatcaagctgcagatctgggacaccgccggccaggagagcttcagaagcatcaccagaagctactacagaggcgccgccggcgccctgctggtgtacgacatcaccagaagagagaccttcaaccacctgaccagctggctggaggacgccagacagcacagcagcagcaacatggtgatcatgctgatcggcaacaagagcgacctggagagcagaagagacgtgaagagagaggagggcgaggccttcgccagagagcacggcctgatcttcatggagaccagcgccaagaccgcctgcaacgtggaggaggccttcatcaacaccgccaaggagatctacagaaagatccagcagggcctgttcgacgtgcacaacgaggccaacggcatcaagatcggcccccagcagagcatcagcaccagcgtgggccccagcgccagccagagcgccggcctgcaggtgtag

SEQ ID NO: 96084 - DNA, 651 bp, Artificial Sequence
  Description of Artificial Sequence: Synthetic coding sequence
atgacctacgcctacctgttcaagtacatcatcatcggcgacaccggcgtgggcaagagctgcctgctgctgcagttcaccgacaagagattccagcccgtgcacgacctgaccatcggcgtggagttcggcgccagaatggtgaacatcgacggcaagcagatcaagctgcagatctgggacaccgccggccaggagagcttcagaagcatcaccagaagctactacagaggcgccgccggcgccctgctggtgtacgacatcaccagaagagagaccttcaaccacctgaccagctggctggaggacgccagacagcacagcagcagcaacatggtgatcatgctgatcggcaacaagagcgacctggagagcagaagagacgtgaagagagaggagggcgaggccttcgccagagagcacggcctgatcttcatggagaccagcgccaagaccgcctgcaacgtggaggaggccttcatcaacaccgccaaggagatctacagaaagatccagcagggcctgttcgacgtgcacaacgaggccaacggcatcaagatcggcccccagcagagcatcagcaccagcgtgggccccagcgccagccagagaaacagcagagacatcggcagcaacagcggctgctgctag

SEQ ID NO: 96085 - DNA, 189 bp, Artificial Sequence
  Description of Artificial Sequence: Synthetic coding sequence
atgacctacgcctacctgttcaagtacatcatcatcggcgacaccggcgtgggcaagagctgcctgctgctgcagttcaccgacaagagattccagcccgtgcacgacctgaccatcggcgtggagttcggcgccagaatggtgaacatcgacggcaagcagatcaagctgcagatctgggacacctag

SEQ ID NO: 96086 - DNA, 2946 bp, Artificial Sequence
  Description of Artificial Sequence: Synthetic coding sequence
atggccgccgacagcgagcccgagagcgaggtgttcgagatcaccgacttcaccaccgccagcgagtgggagagattcatcagcaaggtggaggaggtgctgaacgactggaagctgatcggcaacagcctgggcaagcccctggagaagggcatcttcaccagcggcacctgggaggagaagagcgacgagatcagcttcgccgacttcaagttcagcgtgacccaccactacctggtgcaggagagcaccgacaaggagggcaaggacgagctgctggaggacgtggtgccccagagcatgcaggacctgctgggcatgaacaacgacttcccccccagagcccactgcctggtgagatggtacggcctgagagagttcgtggtgatcgcccccgccgcccacagcgacgccgtgctgagcgagagcaagtgcaacctgctgctgagcagcgtgagcatcgccctgggcaacaccggctgccaggtgcccctgttcgtgcagatccaccacaagtggagaagaatgtacgtgggcgagtgccagggccccggcgtgagaaccgacttcgagatggtgcacctgagaaaggtgcccaaccagtacacccacctgagcggcctgctggacatcttcaagagcaagatcggctgccccctgacccccctgccccccgtgagcatcgccatcagattcacctacgtgctgcaggactggcagcagtacttctggccccagcagccccccgacatcgacgccctggtgggcggcgaggtgggcggcctggagttcggcaagctgcccttcggcgcctgcgaggaccccatcagcgagctgcacctggccaccacctggccccacctgaccgagggcatcatcgtggacaacgacgtgtacagcgacctggaccccatccaggccccccactggagcgtgagagtgagaaaggccgagaacccccagtgcctgctgggcgacttcgtgaccgagttcttcaagatctgcagaagaaaggagagcaccgacgagatcctgggcagaagcgccttcgaggaggagggcaaggagaccgccgacatcacccacgccctgagcaagctgaccgagcccgccagcgtgcccatccacaagctgagcgtgagcaacatggtgcacaccgccaagaagaagatcagaaagcacagaggcgtggaggagagccccctgaacaacgacgtgctgaacaccatcctgctgttcctgttccccgacgccgtgagcgagaagcccctggacggcaccaccagcaccgacaacaacaacccccccagcgagagcgaggactacaacctgtacaaccagttcaagagcgcccccagcgacagcctgacctacaagctggccctgtgcctgtgcatgatcaacttctaccacggcggcctgaagggcgtggcccacctgtggcaggagttcgtgctggagatgagattcagatgggagaacaacttcctgatccccggcctggccagcggcccccccgacctgagatgctgcctgctgcaccagaagctgcagatgctgaactgctgcatcgagagaaagaaggccagagacgagggcaagaagaccagcgccagcgacgtgaccaacatctaccccggcgacgccggcaaggccggcgaccagctggtgcccgacaacctgaaggagaccgacaaggagaagggcgaggtgggcaagagctgggacagctggagcgacagcgaggaggagttcttcgagtgcctgagcgacaccgaggagctgaagggcaacggccaggagagcggcaagaagggcggccccaaggagatggccaacctgagacccgagggcagactgtaccagcacggcaagctgaccctgctgcacaacggcgagcccctgtacatccccgtgacccaggagcccgcccccatgaccgaggacctgctggaggagcagagcgaggtgctggccaagctgggcaccagcgccgagggcgcccacctgagagccagaatgcagagcgcctgcctgctgagcgacatggagagcttcaaggccgccaaccccggctgcagcctggaggacttcgtgagatggtacagccccagagactacatcgaggaggaggtgatcgacgagaagggcaacgtggtgctgaagggcgagctgagcgccagaatgaagatccccagcaacatgtgggtggaggcctgggagaccgccaagcccatccccgccagaagacagagaagactgttcgacgacaccagagaggccgagaaggtgctgcactacctggccatccagaagcccgccgacctggccagacacctgctgccctgcgtgatccacgccgccgtgctgaaggtgaaggaggaggagagcctggagaacatcagcagcgtgaagaagatcatcaagcagatcatcagccacagcagcaaggtgctgcacttccccaaccccgaggacaagaagctggaggagatcatccaccagatcaccaacgtggaggccctgatcgccagagccagaagcctgaaggccaagttcggcaccgagaagtgcgagcaggaggaggagaaggaggacctggagagattcgtgagctgcctgctggagcagcccgaggtgctggtgaccggcgccggcagaggccacgccggcagaatcatccacaagctgttcgtgaacgcccagagagccgccgccatgaccccccccgaggaggagctgaagagaatgggcagccccgaggagagaagacagaacagcgtgagcgacttccccccccccgccggcagagagttcatcctgagaaccaccgtgcccagacccgccccctacagcaaggccctgccccagagaatgtacagcgtgctgaccaaggaggacttcagactggccggcgccttcagcagcgacaccagcttcttctag

SEQ ID NO: 96087 - DNA, 2808 bp, Artificial Sequence
  Description of Artificial Sequence: Synthetic coding sequence
atgttcagcctgatcagcggcatcttcaccagcggcacctgggaggagaagagcgacgagatcagcttcgccgacttcaagttcagcgtgacccaccactacctggtgcaggagagcaccgacaaggagggcaaggacgagctgctggaggacgtggtgccccagagcatgcaggacctgctgggcatgaacaacgacttcccccccagagcccactgcctggtgagatggtacggcctgagagagttcgtggtgatcgcccccgccgcccacagcgacgccgtgctgagcgagagcaagtgcaacctgctgctgagcagcgtgagcatcgccctgggcaacaccggctgccaggtgcccctgttcgtgcagatccaccacaagtggagaagaatgtacgtgggcgagtgccagggccccggcgtgagaaccgacttcgagatggtgcacctgagaaaggtgcccaaccagtacacccacctgagcggcctgctggacatcttcaagagcaagatcggctgccccctgacccccctgccccccgtgagcatcgccatcagattcacctacgtgctgcaggactggcagcagtacttctggccccagcagccccccgacatcgacgccctggtgggcggcgaggtgggcggcctggagttcggcaagctgcccttcggcgcctgcgaggaccccatcagcgagctgcacctggccaccacctggccccacctgaccgagggcatcatcgtggacaacgacgtgtacagcgacctggaccccatccaggccccccactggagcgtgagagtgagaaaggccgagaacccccagtgcctgctgggcgacttcgtgaccgagttcttcaagatctgcagaagaaaggagagcaccgacgagatcctgggcagaagcgccttcgaggaggagggcaaggagaccgccgacatcacccacgccctgagcaagctgaccgagcccgccagcgtgcccatccacaagctgagcgtgagcaacatggtgcacaccgccaagaagaagatcagaaagcacagaggcgtggaggagagccccctgaacaacgacgtgctgaacaccatcctgctgttcctgttccccgacgccgtgagcgagaagcccctggacggcaccaccagcaccgacaacaacaacccccccagcgagagcgaggactacaacctgtacaaccagttcaagagcgcccccagcgacagcctgacctacaagctggccctgtgcctgtgcatgatcaacttctaccacggcggcctgaagggcgtggcccacctgtggcaggagttcgtgctggagatgagattcagatgggagaacaacttcctgatccccggcctggccagcggcccccccgacctgagatgctgcctgctgcaccagaagctgcagatgctgaactgctgcatcgagagaaagaaggccagagacgagggcaagaagaccagcgccagcgacgtgaccaacatctaccccggcgacgccggcaaggccggcgaccagctggtgcccgacaacctgaaggagaccgacaaggagaagggcgaggtgggcaagagctgggacagctggagcgacagcgaggaggagttcttcgagtgcctgagcgacaccgaggagctgaagggcaacggccaggagagcggcaagaagggcggccccaaggagatggccaacctgagacccgagggcagactgtaccagcacggcaagctgaccctgctgcacaacggcgagcccctgtacatccccgtgacccaggagcccgcccccatgaccgaggacctgctggaggagcagagcgaggtgctggccaagctgggcaccagcgccgagggcgcccacctgagagccagaatgcagagcgcctgcctgctgagcgacatggagagcttcaaggccgccaaccccggctgcagcctggaggacttcgtgagatggtacagccccagagactacatcgaggaggaggtgatcgacgagaagggcaacgtggtgctgaagggcgagctgagcgccagaatgaagatccccagcaacatgtgggtggaggcctgggagaccgccaagcccatccccgccagaagacagagaagactgttcgacgacaccagagaggccgagaaggtgctgcactacctggccatccagaagcccgccgacctggccagacacctgctgccctgcgtgatccacgccgccgtgctgaaggtgaaggaggaggagagcctggagaacatcagcagcgtgaagaagatcatcaagcagatcatcagccacagcagcaaggtgctgcacttccccaaccccgaggacaagaagctggaggagatcatccaccagatcaccaacgtggaggccctgatcgccagagccagaagcctgaaggccaagttcggcaccgagaagtgcgagcaggaggaggagaaggaggacctggagagattcgtgagctgcctgctggagcagcccgaggtgctggtgaccggcgccggcagaggccacgccggcagaatcatccacaagctgttcgtgaacgcccagagagccgccgccatgaccccccccgaggaggagctgaagagaatgggcagccccgaggagagaagacagaacagcgtgagcgacttccccccccccgccggcagagagttcatcctgagaaccaccgtgcccagacccgccccctacagcaaggccctgccccagagaatgtacagcgtgctgaccaaggaggacttcagactggccgtgaagatcatcgacggcgacgtgtag

SEQ ID NO: 96088 - DNA, 2967 bp, Artificial Sequence
  Description of Artificial Sequence: Synthetic coding sequence
atggccgccgacagcgagcccgagagcgaggtgttcgagatcaccgacttcaccaccgccagcgagtgggagagattcatcagcaaggtggaggaggtgctgaacgactggaagctgatcggcaacagcctgggcaagcccctggagaagggcatcttcaccagcggcacctgggaggagaagagcgacgagatcagcttcgccgacttcaagttcagcgtgacccaccactacctggtgcaggagagcaccgacaaggagggcaaggacgagctgctggaggacgtggtgccccagagcatgcaggacctgctgggcatgaacaacgacttcccccccagagcccactgcctggtgagatggtacggcctgagagagttcgtggtgatcgcccccgccgcccacagcgacgccgtgctgagcgagagcaagtgcaacctgctgctgagcagcgtgagcatcgccctgggcaacaccggctgccaggtgcccctgttcgtgcagatccaccacaagtggagaagaatgtacgtgggcgagtgccagggccccggcgtgagaaccgacttcgagatggtgcacctgagaaaggtgcccaaccagtacacccacctgagcggcctgctggacatcttcaagagcaagatcggctgccccctgacccccctgccccccgtgagcatcgccatcagattcacctacgtgctgcaggactggcagcagtacttctggccccagcagccccccgacatcgacgccctggtgggcggcgaggtgggcggcctggagttcggcaagctgcccttcggcgcctgcgaggaccccatcagcgagctgcacctggccaccacctggccccacctgaccgagggcatcatcgtggacaacgacgtgtacagcgacctggaccccatccaggccccccactggagcgtgagagtgagaaaggccgagaacccccagtgcctgctgggcgacttcgtgaccgagttcttcaagatctgcagaagaaaggagagcaccgacgagatcctgggcagaagcgccttcgaggaggagggcaaggagaccgccgacatcacccacgccctgagcaagctgaccgagcccgccagcgtgcccatccacaagctgagcgtgagcaacatggtgcacaccgccaagaagaagatcagaaagcacagaggcgtggaggagagccccctgaacaacgacgtgctgaacaccatcctgctgttcctgttccccgacgccgtgagcgagaagcccctggacggcaccaccagcaccgacaacaacaacccccccagcgagagcgaggactacaacctgtacaaccagttcaagagcgcccccagcgacagcctgacctacaagctggccctgtgcctgtgcatgatcaacttctaccacggcggcctgaagggcgtggcccacctgtggcaggagttcgtgctggagatgagattcagatgggagaacaacttcctgatccccggcctggccagcggcccccccgacctgagatgctgcctgctgcaccagaagctgcagatgctgaactgctgcatcgagagaaagaaggccagagacgagggcaagaagaccagcgccagcgacgtgaccaacatctaccccggcgacgccggcaaggccggcgaccagctggtgcccgacaacctgaaggagaccgacaaggagaagggcgaggtgggcaagagctgggacagctggagcgacagcgaggaggagttcttcgagtgcctgagcgacaccgaggagctgaagggcaacggccaggagagcggcaagaagggcggccccaaggagatggccaacctgagacccgagggcagactgtaccagcacggcaagctgaccctgctgcacaacggcgagcccctgtacatccccgtgacccaggagcccgcccccatgaccgaggacctgctggaggagcagagcgaggtgctggccaagctgggcaccagcgccgagggcgcccacctgagagccagaatgcagagcgcctgcctgctgagcgacatggagagcttcaaggccgccaaccccggctgcagcctggaggacttcgtgagatggtacagccccagagactacatcgaggaggaggtgatcgacgagaagggcaacgtggtgctgaagggcgagctgagcgccagaatgaagatccccagcaacatgtgggtggaggcctgggagaccgccaagcccatccccgccagaagacagagaagactgttcgacgacaccagagaggccgagaaggtgctgcactacctggccatccagaagcccgccgacctggccagacacctgctgccctgcgtgatccacgccgccgtgctgaaggtgaaggaggaggagagcctggagaacatcagcagcgtgaagaagatcatcaagcagatcatcagccacagcagcaaggtgctgcacttccccaaccccgaggacaagaagctggaggagatcatccaccagatcaccaacgtggaggccctgatcgccagagccagaagcctgaaggccaagttcggcaccgagaagtgcgagcaggaggaggagaaggaggacctggagagattcgtgagctgcctgctggagcagcccgaggtgctggtgaccggcgccggcagaggccacgccggcagaatcatccacaagctgttcgtgaacgcccagagactgaccgagagcagcgacgaggccgccgccatgaccccccccgaggaggagctgaagagaatgggcagccccgaggagagaagacagaacagcgtgagcgacttccccccccccgccggcagagagttcatcctgagaaccaccgtgcccagacccgccccctacagcaaggccctgccccagagaatgtacagcgtgctgaccaaggaggacttcagactggccggcgccttcagcagcgacaccagcttcttctag

SEQ ID NO: 96089 - DNA, 4182 bp, Artificial Sequence
  Description of Artificial Sequence: Synthetic coding sequence
atggcctgcagcatcgtgcagttctgctacttccaggacctgcaggccgccagagacttcctgttcccccacctgagagaggagatcctgagcggcgccctgagaagagaccccagcaagagcaccgactgggaggacgacggctggggcgcctgggaggagaacgagccccaggagcccgaggaggagggcaacacctgcaagacccagaagaccagctggctgcaggactgcgtgctgagcctgagccccaccaacgacctgatggtgatcgccagagagcagaaggccgtgttcctggtgcccaagtggaagtacagcgacaagggcaaggaggagatgcagttcgccgtgggctggagcggcagcctgaacgtggaggagggcgagtgcgtgaccagcgccctgtgcatccccctggccagccagaagagaagcagcaccggcagacccgactggacctgcatcgtggtgggcttcaccagcggctacgtgagattctacaccgagaacggcgtgctgctgctggcccagctgctgaacgaggaccccgtgctgcagctgaagtgcagaacctacgagatccccagacaccccggcgtgaccgagcagaacgaggagctgagcatcctgtaccccgccgccatcgtgaccatcgacggcttcagcctgttccagagcctgagagcctgcagaaaccaggtggccaaggccgccgccagcggcaacgagaacatccagcccccccccctggcctacaagaagtggggcctgcaggacatcgacaccatcatcgaccacgccagcgtgggcatcatgaccctgagccccttcgaccagatgaagaccgccagcaacatcggcggcttcaacgccgccatcaagaacagcccccccgccatgagccagtacatcaccgtgggcagcaaccccttcaccggcttcttctacgccctggagggcagcacccagcccctgctgagccacgtggccctggccgtggccagcaagctgaccagcgccctgttcaacgccgccagcggctggctgggctggaagagcaagcacgaggaggaggccgtgcagaagcagaagcccaaggtggagcccgccacccccctggccgtgagattcggcctgcccgacagcagaagacacggcgagagcatctgcctgagcccctgcaacaccctggccgccgtgaccgacgacttcggcagagtgatcctgctggacgtggccagaggcatcgccatcagaatgtggaagggctacagagacgcccagatcggctggatccagaccgtggaggacctgcacgagagagtgcccgagaaggccgacttcagccccttcggcaacagccagggccccagcagagtggcccagttcctggtgatctacgcccccagaagaggcatcctggaggtgtggagcacccagcagggccccagagtgggcgccttcaacgtgggcaagcactgcagactgctgtaccccggctacaagatcatgggcctgaacaacgtgaccagccagagctggcagccccagacctaccagatctgcctggtggaccccgtgagcggcagcgtgaagaccgtgaacgtgcccttccacctggccctgagcgacaagaagagcgagagagccaaggacatgcacctggtgaagaagctggccgccctgctgaagaccaagagccccaacctggacctggtggagaccgagatcaaggagctgatcctggacatcaagtaccccgccaccaagaagcaggccctggagagcatcctggccagcgagagactgcccttcagctgcctgagaaacatcacccagaccctgatggacaccctgaagagccaggagctggagagcgtggacgagggcctgctgcagttctgcgccaacaagctgaagctgctgcagctgtacgagagcgtgagccagctgaacagcctggacttccacctggacacccccttcagcgacaacgacctggccctgctgctgagactggacgagaaggagctgctgaagctgcaggccctgctggagaagtacaagcaggagaacaccagaaccaacgtgagattcagcgacgacaaggacggcgtgctgcccgtgaagaccttcctggagtacctggagtacgagaaggacgtgctgaacatcaagaagatcagcgaggaggagtacgtggccctgggcagcttcttcttctggaagtgcctgcacggcgagagcagcaccgaggacatgtgccacaccctggagagcgccggcctgagcccccagctgctgctgagcctgctgctgagcgtgtggctgagcaaggagaaggacatcctggacaagccccagagcatctgctgcctgcacaccatgctgagcctgctgagcaagatgaaggtggccatcgacgagacctgggacagccagagcgtgagcccctggtggcagcagatgagaaccgcctgcatccagagcgagaacaacggcgccgccctgctgagcgcccacgtgggccacagcgtggccgcccagatcagcaacaacatgaccgagaagaagttcagccagaccgtgctgggcgccgacagcgaggccctgaccgacagctgggaggccctgagcctggacaccgagtactggaagctgctgctgaagcagctggaggactgcctgatcctgcagaccctgctgcacagcaagggcaacacccagaccagcaaggtgagcagcctgcaggccgagcccctgcccagactgagcgtgaagaagctgctggagggcggcaagggcggcatcgccgacagcgtggccaagtggatcttcaagcaggacttcagccccgaggtgctgaagctggccaacgaggagagagacgccgagaaccccgacgagcccaaggagggcgtgaacagaagcttcctggaggtgagcgagatggagatggacctgggcgccatccccgacctgctgcacctggcctacgagcagttcccctgcagcctggagctggacgtgctgcacgcccactgctgctgggagtacgtggtgcagtggaacaaggaccccgaggaggccagattcttcgtgagaagcatcgagcacctgaagcagatcttcaacgcccacgtgcagaacggcatcgccctgatgatgtggaacaccttcctggtgaagagattcagcgccgccacctacctgatggacaaggtgggcaagagccccaaggacagactgtgcagaagagacgtgggcatgagcgacaccgccatgaccagcttcctgggcagctgcctggacctgctgcagatcctgatggaggccgacgtgagcagagacgagatccaggtgcccgtgctggacaccgaggacgcctggctgagcgtggagggccccatcagcatcgtggagctggccctggagcagaagcacatccactaccccctggtggagcaccacagcatcctgtgcagcatcctgtacgccgtgatgagattcagcctgaagaccgtgaagcccctgagcctgttcgacagcaagggcaagaacgccttcttcaaggacctgaccagcatccagctgctgcccagcggcgagatggaccccaacttcatcagcgtgagacagcagttcctgctgaaggtggtgagcgccgccgtgcaggcccagcacagcgccaccaaggtgaaggaccccaccgaggaggccacccccacccccttcggcaaggaccaggactggcccgccctggccgtggacctggcccaccacctgcaggtgagcgaggacgtggtgagaagacactacgtgggcgagctgtacaactacggcgtggaccacctgggcgaggaggccatcctgcaggtgcacgacaaggaggtgctggccagccagctgctggtgctgaccggccagagactggcccacgccctgctgcacacccagaccaaggagggcatggagctgctggccagactgccccccaccctgtgcacctggctgaaggccatggacccccaggacctgcagaacaccgaggtgcccatcgccaccaccgccaagctggtgaacaaggtgatcgagctgctgcccgagaagcacggccagtacggcctggccctgcacctgatcgaggccgtggaggccatcagcctgcccagcctgtag

SEQ ID NO: 96090 - DNA, 612 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgcccgagtggctgagagagatcgagcagtacgccagcaacaaggtgatcaccgtgctggtgggcaacaagatcgacctggccgagagaagagaggtgagccagcagagagccgaggagttcagcgaggcccaggacatgtactacctggagaccagcgccaaggagagcgacaacgtggagaagctgttcctggacctggcctgcagactgatcagcgaggccagacagaacaccctggtgaacaacgtgagcagccccctgcccggcgagggcaagagcatcagctacctgacctgctgcaacttcaactag

SEQ ID NO: 96091 - DNA, 345 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgcccgagtggctgagagagatcgagcagtacgccagcaacaagtag

SEQ ID NO: 96092 - DNA, 612 bp, Artificial Sequence; identical to SEQ ID NO: 96090
  Description of Artificial Sequence: Synthetic coding sequence

SEQ ID NO: 96093 - DNA, 168 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggctag

SEQ ID NO: 96094 - DNA, 507 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgcccgagtggctgagagagatcgagcagtacgccagcaacaaggtgatcaccgtgctggtgggcaacaagatcgacctggccgagagaagagaggtgagccagcagagagccgaggagttcagcgaggcccaggacatgtactacctggagaccagcgccaaggagagcgacaacgtggagaagctgttcctggacctggcctgctag

SEQ ID NO: 96095 - DNA, 183 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgtag

SEQ ID NO: 96096 - DNA, 612 bp, Artificial Sequence; identical to SEQ ID NO: 96090
  Description of Artificial Sequence: Synthetic coding sequence

SEQ ID NO: 96097 - DNA, 303 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgtag

SEQ ID NO: 96098 - DNA, 495 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgcccgagtggctgagagagatcgagcagtacgccagcaacaaggtgatcaccgtgctggccaccagactgacctggctgaagggcgagagattccccagcagcgagctgaagaacagccagaagctgagaacctgcatcatctggagaccccagcccagaaacctgatcatgtggagaaacagcagcctgacctag

SEQ ID NO: 96099 - DNA, 420 bp, Artificial Sequence
  Description of Artificial Sequence: Synthetic coding sequence
atgagcatggaggactacgacttcctgttcaagatcgtgctgatcggcaacgccggcgtgggcaagacctgcctggtgagaagattcacccagggcctgttcccccccggccagggcgccaccatcggcgtggacttcatgatcaagaccgtggagatcaacggcgagaaggtgaagctgcagatctgggacaccgccggccaggagagattcagaagcatcacccagagctactacagaagcgccaacgccctgatcctgacctacgacatcacctgcgaggagagcttcagatgcctgcccgagtggctgagagagatcgagcagtacgccagcaacaaggtgatcaccgtgctggtgggcaacaagatcgacctggccgagagaagagaggtgagccagcagagagccgaggagtag

SEQ ID NO: 96100 - DNA, 588 bp, Artificial Sequence
  Description of Artificial Sequence: Synthetic coding sequence
atgatggccatcagagagctgaaggtgtgcctgctgggcgacaccggcgtgggcaagagcagcatcgtgtgcagattcgtgcaggaccacttcgaccacaacatcagccccaccatcggcgccagcttcatgaccaagaccgtgccctgcggcaacgagctgcacaagttcctgatctgggacaccgccggccaggagagattccacagcctggcccccatgtactacagaggcagcgccgccgccgtgatcgtgtacgacatcaccaagcaggacagcttctacaccctgaagaagtgggtgaaggagctgaaggagcacggccccgagaacatcgtgatggccatcgccggcaacaagtgcgacctgagcgacatcagagaggtgcccctgaaggacgccaaggagtacgccgagagcatcggcgccatcgtggtggagaccagcgccaagaacgccatcaacatcgaggagctgttccagggcatcagcagacagatcccccccctggacccccacgagaacggcaacaacggcaccatcaaggtggagaagcccaccatgcaggccagcagaagatgctgctag

SEQ ID NO: 96101 - DNA, 561 bp, Artificial Sequence
  Description of Artificial Sequence: Synthetic coding sequence
tgcctgctgaacgacaccggcgtgggcaagagcagcatcgtgtgcagattcgtgcaggaccacttcgaccacaacatcagccccaccatcggcgccagcttcatgaccaagaccgtgccctgcggcaacgagctgcacaagttcctgatctgggacaccgccggccaggagagattccacagcctggcccccatgtactacagaggcagcgccgccgccgtgatcgtgtacgacatcaccaagcaggacagcttctacaccctgaagaagtgggtgaaggagctgaaggagcacggccccgagaacatcgtgatggccatcgccggcaacaagtgcgacctgagcgacatcagagaggtgcccctgaaggacgccaaggagtacgccgagagcatcggcgccatcgtggtggagaccagcgccaagaacgccatcaacatcgaggagctgttccagggcatcagcagacagatcccccccctggacccccacgagaacggcaacaacggcaccatcaaggtggagaagcccaccatgcaggccagcagaagatgctgctag

SEQ ID NO: 96102 - DNA, 678 bp, Artificial Sequence
  Description of Artificial Sequence: Synthetic coding sequence
atggccggcggcggcgccggcgaccccggcctgggcgccgccgccgcccccgcccccgagaccagagagcacctgttcaaggtgctggtgatcggcgagctgggcgtgggcaagaccagcatcatcaagagatacgtgcaccagctgttcagccagcactacagagccaccatcggcgtggacttcgccctgaaggtgctgaactgggacagcagaaccctggtgagactgcagctgtgggacatcgccggccaggagagattcggcaacatgaccagagtgtactacaaggaggccgtgggcgccttcgtggtgttcgacatcagcagaagcagcaccttcgaggccgtgctgaagtggaagagcgacctggacagcaaggtgcacctgcccaacggcagccccatccccgccgtgctgctggccaacaagtgcgaccagaacaaggacagcagccagagccccagccaggtggaccagttctgcaaggagcacggcttcgccggctggttcgagaccagcgccaaggacaacatcaacatcgaggaggccgccagattcctggtggagaagatcctggtgaaccaccagagcttccccaacgaggagaacgacgtggacaagatcaagctggaccaggagaccctgagagccgagaacaagagccagtgctgctag

SEQ ID NO: 96103 - DNA, 714 bp, Artificial Sequence
  Description of Artificial Sequence: Synthetic coding sequence
atggcccagcccatcctgggccacggcagcctgcagcccgccagcgccgccggcctggccagcctggagctggacagcagcctggaccagtacgtgcagatcagaatcttcaagatcatcgtgatcggcgacagcaacgtgggcaagacctgcctgaccttcagattctgcggcggcaccttccccgacaagaccgaggccaccatcggcgtggacttcagagagaagaccgtggagatcgagggcgagaagatcaaggtgcaggtgtgggacaccgccggccaggagagattcagaaagagcatggtggagcactactacagaaacgtgcacgccgtggtgttcgtgtacgacgtgaccaagatgaccagcttcaccaacctgaagatgtggatccaggagtgcaacggccacgccgtgccccccctggtgcccaaggtgctggtgggcaacaagtgcgacctgagagagcagatccaggtgcccagcaacctggccctgaagttcgccgacgcccacaacatgctgctgttcgagaccagcgccaaggaccccaaggagagccagaacgtggagagcatcttcatgtgcctggcctgcagactgaaggcccagaagagcctgctgtacagagacgccgagagacagcagggcaaggtgcagaagctggagttcccccaggaggccaacagcaagaccagctgcccctgctag

SEQ ID NO: 96104 - DNA, 714 bp, Artificial Sequence
  Description of Artificial Sequence: Synthetic coding sequence
atgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaaggccgagtactgggccgtgagcagcctgaccggcgagaacgtgagagagttcttcttcagagtggccgccctgaccttcgaggccaacgtgctggccgagctggagaagagcggcgccagaagaatcggcgacgtggtgagaatcaacagcgacgacagcaacctgtacctgaccgccagcaagaagaagcccacctgctgcccctag

SEQ ID NO: 96105 - DNA, 780 bp, Artificial Sequence
  Description of Artificial Sequence: Synthetic coding sequence
atgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaaggccgagtactgggccgtgagcagcctgaccggcgagaacgtgagagagttcttcttcagagtggccgccctgaccttcgaggccaacgtgctggccgagctggagaagagcggcgccagaagaatcggcgacgtggtgagaatcaacagcgacgacagcaacctgtacctgaccgccagcaagaagaagcccacctgctgcccctag

SEQ ID NO: 96106 - DNA, 636 bp, Artificial Sequence
  Description of Artificial Sequence: Synthetic coding sequence
atgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaaggccgagtactgggccgtgagcagcctgaccggcgagaacgtgagagagttcttcttcagatag

SEQ ID NO: 96107 - DNA, 756 bp, Artificial Sequence
  Description of Artificial Sequence: Synthetic coding sequence
atgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctgacccccgcccagtacgccctgatggagaaggacgccctgcaggtggcccaggagatgaaggccgagtactgggccgtgagcagcctgaccggcgagaacgtgagagagttcttcttcagagtggccgccctgaccttcgaggccaacgtgctggccgagctggagaagagcggcgccagaagaatcggcgacgtggtgagaatcaacagcgacgacagcaacctgtacctgaccgccagcaagaagaagcccacctgctgcccctag

SEQ ID NO: 96108 - DNA, 780 bp, Artificial Sequence; identical to SEQ ID NO: 96105
  Description of Artificial Sequence: Synthetic coding sequence

SEQ ID NO: 96109 - DNA, 636 bp, Artificial Sequence; identical to SEQ ID NO: 96106
  Description of Artificial Sequence: Synthetic coding sequence

SEQ ID NO: 96110 - DNA, 696 bp, Artificial Sequence
  Description of Artificial Sequence: Synthetic coding sequence
tgaagcctgagattccccatcaccaacagcgccggcgccccctgcaaggccgccggcagaatgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcagattcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaagaccgtgcagagactgcccagccccagagccctgtgccacccccacagcagcagagcctag

SEQ ID NO: 96111 - DNA, 951 bp, Artificial Sequence
  Description of Artificial Sequence: Synthetic coding sequence
atgagccacctgcccggcctggagctgagaagagaggccccccccctgctgggccccctgctgagccccttccccctgcccgccggcagctggcacagacagatgctgagaagcagcctgagattccccatcaccaacagcgccggcgccccctgcaaggccgccggcagaatgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaaggccgagtactgggccgtgagcagcctgaccggcgagaacgtgagagagttcttcttcagagtggccgccctgaccttcgaggccaacgtgctggccgagctggagaagagcggcgccagaagaatcggcgacgtggtgagaatcaacagcgacgacagcaacctgtacctgaccgccagcaagaagaagcccacctgctgcccctag

SEQ ID NO: 96112 - DNA, 825 bp, Artificial Sequence
  Description of Artificial Sequence: Synthetic coding sequence
atgctgagaagcagcctgagattccccatcaccaacagcgccggcgccccctgcaaggccgccggcagaatgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcttcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctgacccccgcccagtacgccctgatggagaaggacgccctgcaggtggcccaggagatgaaggccgagtactgggccgtgagcagcctgaccggcgagaacgtgagagagttcttcttcagagtggccgccctgaccttcgaggccaacgtgctggccgagctggagaagagcggcgccagaagaatcggcgacgtggtgagaatcaacagcgacgacagcaacctgtacctgaccgccagcaagaagaagcccacctgctgcccctag

SEQ ID NO: 96113 - DNA, 807 bp, Artificial Sequence
  Description of Artificial Sequence: Synthetic coding sequence
atgagccacctgcccggcctggagctgagaagagaggccccccccctgctgggccccctgctgagccccttccccctgcccgccggcagctggcacagacagatgctgagaagcagcctgagattccccatcaccaacagcgccggcgccccctgcaaggccgccggcagaatgaacatcctggcccccgtgagaagagacagagtgctggccgagctgccccagtgcctgagaaaggaggccgccctgcacggccacaaggacttccaccccagagtgacctgcgcctgccaggagcacagaaccggcaccgtgggcagattcaagatcagcaaggtgatcgtggtgggcgacctgagcgtgggcaagacctgcctgatcaacagattctgcaaggacaccttcgacaagaactacaaggccaccatcggcgtggacttcgagatggagagattcgaggtgctgggcatccccttcagcctgcagctgtgggacaccgccggccaggagagattcaagtgcatcgccagcacctactacagaggcgcccaggccatcatcatcgtgttcaacctgaacgacgtggccagcctggagcacaccaagcagtggctggccgacgccctgaaggagaacgaccccagcagcgtgctgctgttcctggtgggcagcaagaaggacctgagcacccccgcccagtacgccctgatggagaaggacgccctgcaggtggcccaggagatgaagaccgtgcagagactgcccagccccagagccctgtgccacccccacagcagcagagcctag

SEQ ID NO: 96114 - DNA, 1002 bp, Artificial Sequence
  Description of Artificial Sequence: Synthetic coding sequence
atggtgatcgccggcgccagctggatgctgggcagagccgccgccagccccacccagaccccccccaccaccagcaccatcagagtggccagaagaagcagagtggccctggtggccatggtgatcgccgccgccggcagcggcggccccggcagagccgagccccagctgagccagcccagcctggactgcggcagaatgagaagcagcctgacccccctgggcccccccgtgagcagagacagagtgatcgccagcttccccaagtggtacacccccgaggcctgcctgcagctgagagagcacttccacggccaggtgagcgccgcctgccagagaagaaacaccggcaccgtgggcctgaagctgagcaaggtggtggtggtgggcgacctgtacgtgggcaagaccagcctgatccacagattctgcaagaacgtgttcgacagagactacaaggccaccatcggcgtggacttcgagatcgagagattcgagatcgccggcatcccctacagcctgcagatctgggacaccgccggccaggagaagttcaagtgcatcgccagcgcctactacagaggcgcccaggtgatcatcaccgccttcgacctgaccgacgtgcagaccctggagcacaccagacagtggctggaggacgccctgagagagaacgaggccggcagctgcttcatcttcctggtgggcaccaagaaggacctgctgagcggcgccgcctgcgagcaggccgaggccgacgccgtgcacctggccagagagatgcaggccgagtactggagcgtgagcgccaagaccggcgagaacgtgaaggccttcttcagcagagtggccgccctggccttcgagcagagcgtgctgcaggacctggagagacagagcagcgccagactgcaggtgggcaacggcgacctgatccagatggagggcagcccccccgagacccaggagagcaagagacccagcagcctgggctgctgctag

SEQ ID NO: 96115 - DNA, 936 bp, Artificial Sequence
  Description of Artificial Sequence: Synthetic coding sequence
atggtgatcgccggcgccagctggatgctgggcagagccgccgccagccccacccagaccccccccaccaccagcaccatcagagtggccagaagaagcagagtggccctggtggccatggtgatcgccgccgccggcagcggcggccccggcagagccgagccccagctgagccagcccagcctggactgcggcagaatgagaagcagcctgacccccctgggcccccccgtgagcagagacagagtgatcgccagcttccccaagtggtacacccccgaggcctgcctgcagctgagagagcacttccacggccaggtgagcgccgcctgccagagaagaaacaccggcaccgtgggcttctgcaagaacgtgttcgacagagactacaaggccaccatcggcgtggacttcgagatcgagagattcgagatcgccggcatcccctacagcctgcagatctgggacaccgccggccaggagaagttcaagtgcatcgccagcgcctactacagaggcgcccaggtgatcatcaccgccttcgacctgaccgacgtgcagaccctggagcacaccagacagtggctggaggacgccctgagagagaacgaggccggcagctgcttcatcttcctggtgggcaccaagaaggacctgctgagcggcgccgcctgcgagcaggccgaggccgacgccgtgcacctggccagagagatgcaggccgagtactggagcgtgagcgccaagaccggcgagaacgtgaaggccttcttcagcagagtggccgccctggccttcgagcagagcgtgctgcaggacctggagagacagagcagcgccagactgcaggtgggcaacggcgacctgatccagatggagggcagcccccccgagacccaggagagcaagagacccagcagcctgggctgctgctag

SEQ ID NO: 96116 - DNA, 498 bp, Artificial Sequence
  Description of Artificial Sequence: Synthetic coding sequence
atggtgatcgccgccgccggcagcggcggccccggcagagccgagccccagctgagccagcccagcctggactgcggcagaatgagaagcagcctgacccccctgggcccccccgtgagcagagacagagtgatcgccagcttccccaagtggtacacccccgaggcctgcctgcagctgagagagcacttccacggccaggtgagcgccgcctgccagagaagaaacaccggcaccgtgggcctgaagctgagcaaggtggtggtggtgggcgacctgtacgtgggcaagaccagcctgagcgcccagtacgcccacccccagggcttcctgaccgccatgaaccagccccacagccccagacccctgagccccggctacgcccacagcagccaccccagcagagccgtggccagcagaagatggagagccccctgcagacagcccagcgaccagtactgcagccccagagcctggcacaccgccgccgccctgtag

SEQ ID NO: 96117 - DNA, 549 bp, Artificial Sequence
  Description of Artificial Sequence: Synthetic coding sequence
atggacctgcagagacccgacagctaccagggcggcgccggccccgacttcaacgaccacgtgctgcacaagaccatcctggtgggcgacagcggcgtgggcaagaccagcctgctggtgcagttcgaccagggcaagttcatccccggcagcttcagcgccaccgtgggcatcggcttcaccaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaagtag

SEQ ID NO: 96118 - DNA, 570 bp, Artificial Sequence
  Description of Artificial Sequence: Synthetic coding sequence
atgaccggcacccccggcgccgtggccaccagagacggcgaggcccccgagagaagccccccctgcagccccagctacgacctgaccggcaaggtgatgctgctgggcgacaccggcgtgggcaagacctgcttcctgatccagttcaaggacggcgccttcctgagcggcaccttcatcgccaccgtgggcatcgacttcagaaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaagtag

SEQ ID NO: 96119 - DNA, 561 bp, Artificial Sequence
  Description of Artificial Sequence: Synthetic coding sequence
atgaccggcacccccggcgccgtggccaccagagacggcgaggcccccgagagaagccccccctgcagccccagctacgacctgaccggcaagaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96120 - DNA, 672 bp, Artificial Sequence
  Description of Artificial Sequence: Synthetic coding sequence
atgaccggcacccccggcgccgtggccaccagagacggcgaggcccccgagagaagccccccctgcagccccagctacgacctgaccggcaaggtgatgctgctgggcgacaccggcgtgggcaagacctgcttcctgatccagttcaaggacggcgccttcctgagcggcaccttcatcgccaccgtgggcatcgacttcagaaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96121 - DNA, 687 bp, Artificial Sequence
  Description of Artificial Sequence: Synthetic coding sequence
atgtggctgatgagcgaggcccacggcgccgagcccgtgctgctgagagaggccgccagacccttcacccagaccctgagactgtgcgtgcccagcggcaacagcaaggtgatgctgctgggcgacaccggcgtgggcaagacctgcttcctgatccagttcaaggacggcgccttcctgagcggcaccttcatcgccaccgtgggcatcgacttcagaaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96122 - DNA, 576 bp, Artificial Sequence
  Description of Artificial Sequence: Synthetic coding sequence
atgtggctgatgagcgaggcccacggcgccgagcccgtgctgctgagagaggccgccagacccttcacccagaccctgagactgtgcgtgcccagcggcaacagcaagaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96123 - DNA, 510 bp, Artificial Sequence
  Description of Artificial Sequence: Synthetic coding sequence
atggacctgcagagacccgacagctaccagggcggcgccggccccgacttcaacgaccacgtgctgcacaagaccatcctggtgggcgacagcggcgtgggcaagaccagcctgctggtgcagttcgaccagggcaagttcatccccggcagcttcagcgccaccgtgggcatcggcttcaccaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggtgagcggcagcggcgccggcagcgcccagccctgcaccagcagcgccctggccggccccatcaccacccaggagcagctgagcagacaccccagctag

SEQ ID NO: 96124 - DNA, 651 bp, Artificial Sequence
  Description of Artificial Sequence: Synthetic coding sequence
atggacctgcagagacccgacagctaccagggcggcgccggccccgacttcaacgaccacgtgctgcacaagaccatcctggtgggcgacagcggcgtgggcaagaccagcctgctggtgcagttcgaccagggcaagttcatccccggcagcttcagcgccaccgtgggcatcggcttcaccaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96125 - DNA, 651 bp, Artificial Sequence; identical to SEQ ID NO: 96124
  Description of Artificial Sequence: Synthetic coding sequence

SEQ ID NO: 96126 - DNA, 672 bp, Artificial Sequence; identical to SEQ ID NO: 96120
  Description of Artificial Sequence: Synthetic coding sequence

SEQ ID NO: 96127 - DNA, 591 bp, Artificial Sequence
  Description of Artificial Sequence: Synthetic coding sequence
atgtgctgcaaggtgatgctgctgggcgacaccggcgtgggcaagacctgcttcctgatccagttcaaggacggcgccttcctgagcggcaccttcatcgccaccgtgggcatcgacttcagaaacaaggtggtgaccgtggacggcgtgagagtgaagctgcagatctgggacaccgccggccaggagagattcagaagcgtgacccacgcctactacagagacgcccaggccctgctgctgctgtacgacatcaccaacaagagcagcttcgacaacatcagagcctggctgaccgagatccacgagtacgcccagagagacgtggtgatcatgctgctgggcaacaaggccgacatgagcagcgagagagtgatcagaagcgaggacggcgagaccctggccagagagtacggcgtgcccttcctggagaccagcgccaagaccggcatgaacgtggagctggccttcctggccatcgccaaggagctgaagtacagagccggccaccaggccgacgagcccagcttccagatcagagactacgtggagagccagaagaagagaagcagctgctgcagcttcatgtag

SEQ ID NO: 96128 - DNA, 636 bp, Artificial Sequence
  Description of Artificial Sequence: Synthetic coding sequence
atgcaggccccccacaaggagcacctgtacaagctgctggtgatcggcgacctgggcgtgggcaagaccagcatcatcaagagatacgtgcaccagaacttcagcagccactacagagccaccatcggcgtggacttcgccctgaaggtgctgcactgggaccccgagaccgtggtgagactgcagctgtgggacatcgccggccaggagagattcggcaacatgaccagagtgtactacagagaggccatgggcgccttcatcgtgttcgacgtgaccagacccgccaccttcgaggccgtggccaagtggaagaacgacctggacagcaagctgagcctgcccaacggcaagcccgtgagcgtggtgctgctggccaacaagtgcgaccagggcaaggacgtgctgatgaacaacggcctgaagatggaccagttctgcaaggagcacggcttcgtgggctggttcgagaccagcgccaaggagaacatcaacatcgacgaggccagcagatgcctggtgaagcacatcctggccaacgagtgcgacctgatggagagcatcgagcccgacgtggtgaagccccacctgaccagcaccaaggtggccagctgcagcggctgcgccaagagctag

SEQ ID NO: 96129 - DNA, 642 bp, Artificial Sequence
  Description of Artificial Sequence: Synthetic coding sequence
atggaggccatctggctgtaccagttcagactgatcgtgatcggcgacagcaccgtgggcaagagctgcctgatcagaagattcaccgagggcagattcgcccaggtgagcgaccccaccgtgggcgtggacttcttcagcagactggtggagatcgagcccggcaagagaatcaagctgcagatctgggacaccgccggccaggagagattcagaagcatcaccagagcctactacagaaacagcgtgggcggcctgctgctgttcgacatcaccaacagaagaagcttccagaacgtgcacgagtggctggaggagaccaaggtgcacgtgcagccctaccagatcgtgttcgtgctggtgggccacaagtgcgacctggacacccagagacaggtgaccagacacgaggccgagaagctggccgccgcctacggcatgaagtacatcgagaccagcgccagagacgccatcaacgtggagaaggccttcaccgacctgaccagagacatctacgagctggtgaagagaggcgagatcaccatccaggagggctgggagggcgtgaagagcggcttcgtgcccaacgtggtgcacagcagcgaggaggtggtgaagagcgagagaagatgcctgtgctag

SEQ ID NO: 96130 - DNA, 2187 bp, Artificial Sequence
  Description of Artificial Sequence: Synthetic coding sequence
atggccggccccgagggcttccagtacagagccctgtaccccttcagaagagagagacccgaggacctggagctgctgcccggcgacgtgctggtggtgagcagagccgccctgcaggccctgggcgtggccgagggcggcgagagatgcccccagagcgtgggctggatgcccggcctgaacgagagaaccagacagagaggcgacttccccggcacctacgtggagttcctgggccccgtggccctggccagacccggccccagacccagaggccccagacccctgcccgccagacccagagacggcgcccccgagcccggcctgaccctgcccgacctgcccgagcagttcagcccccccgacgtggccccccccctgctggtgaagctggtggaggccatcgagagaaccggcctggacagcgagagccactacagacccgagctgcccgcccccagaaccgactggagcctgagcgacgtggaccagtgggacaccgccgccctggccgacggcatcaagagcttcctgctggccctgcccgcccccctggtgacccccgaggccagcgccgaggccagaagagccctgagagaggccgccggccccgtgggccccgccctggagccccccaccctgcccctgcacagagccctgaccctgagattcctgctgcagcacctgggcagagtggccagcagagcccccgccctgggccccgccgtgagagccctgggcgccaccttcggccccctgctgctgagagccccccccccccccagcagccccccccccggcggcgcccccgacggcagcgagcccagccccgacttccccgccctgctggtggagaagctgctgcaggagcacctggaggagcaggaggtggccccccccgccctgccccccaagccccccaaggccaagcccgccagcaccgtgctggccaacggcggcagcccccccagcctgcaggacgccgagtggtactggggcgacatcagcagagaggaggtgaacgagaagctgagagacacccccgacggcaccttcctggtgagagacgccagcagcaagatccagggcgagtacaccctgaccctgagaaagggcggcaacaacaagctgatcaaggtgttccacagagacggccactacggcttcagcgagcccctgaccttctgcagcgtggtggacctgatcaaccactacagacacgagagcctggcccagtacaacgccaagctggacaccagactgctgtaccccgtgagcaagtaccagcaggaccagatcgtgaaggaggacagcgtggaggccgtgggcgcccagctgaaggtgtaccaccagcagtaccaggacaagagcagagagtacgaccagctgtacgaggagtacaccagaaccagccaggagctgcagatgaagagaaccgccatcgaggccttcaacgagaccatcaagatcttcgaggagcagggccagacccaggagaagtgcagcaaggagtacctggagagattcagaagagagggcaacgagaaggagatgcagagaatcctgctgaacagcgagagactgaagagcagaatcgccgagatccacgagagcagaaccaagctggagcagcagctgagagcccaggccagcgacaacagagagatcgacaagagaatgaacagcctgaagcccgacctgatgcagctgagaaagatcagagaccagtacctggtgtggctgacccagaagggcgccagacagaagaagatcaacgagtggctgggcatcaagaacgagaccgaggaccagtacgccctgatggaggacgaggacgacctgccccaccacgaggagagaacctggtacgtgggcaagatcaacagaacccaggccgaggagatgctgagcggcaagagagacggcaccttcctgatcagagagagcagccagagaggctgctacgcctgcagcgtggtggtggacggcgacaccaagcactgcgtgatctacagaaccgccaccggcttcggcttcgccgagccctacaacctgtacggcagcctgaaggagctggtgctgcactaccagcacgccagcctggtgcagcacaacgacgccctgaccgtgaccctggcccaccccgtgagagcccccggccccggccccccccccgccgccagatag

SEQ ID NO: 96131 - DNA, 660 bp, Artificial Sequence
  Description of Artificial Sequence: Synthetic coding sequence
atggccagcgtgaccgacggcaagaccggcgtgaaggacgccagcgaccagaacttcgactacatgttcaagctgctgatcatcggcaacagcagcgtgggcaagaccagcttcctgttcagatacgccgacgacaccttcacccccgccttcgtgagcaccgtgggcatcgacttcaaggtgaagaccgtgtacagacacgagaagagagtgaagctgcagatctgggacaccgccggccaggagagatacagaaccatcaccaccgcctactacagaggcgccatgggcttcatcctgatgtacgacatcaccaacgaggagagcttcaacgccgtgcaggactgggccacccagatcaagacctacagctgggacaacgcccaggtgatcctggtgggcaacaagtgcgacatggaggaggagagagtggtgcccaccgagaagggccagctgctggccgagcagctgggcttcgacttcttcgaggccagcgccaaggagaacatcagcgtgagacaggccttcgagagactggtggacgccatctgcgacaagatgagcgacagcctggacaccgaccccagcatgctgggcagcagcaagaacaccagactgagcgacaccccccccctgctgcagcagaactgcagctgctag

SEQ ID NO: 96132 - DNA, 660 bp, Artificial Sequence; identical to SEQ ID NO: 96131
  Description of Artificial Sequence: Synthetic coding sequence

SEQ ID NO: 96133 - DNA, 684 bp, Artificial Sequence
  Description of Artificial Sequence: Synthetic coding sequence
atgagacacgaggcccccatgcagatggccagcgcccaggacgccagatacggccagaaggacagcagcgaccagaacttcgactacatgttcaagctgctgatcatcggcaacagcagcgtgggcaagaccagcttcctgttcagatacgccgacgacagcttcaccagcgccttcgtgagcaccgtgggcatcgacttcaaggtgaagaccgtgttcaagaacgagaagagaatcaagctgcagatctgggacaccgccggccaggagagatacagaaccatcaccaccgcctactacagaggcgccatgggcttcatcctgatgtacgacatcaccaacgaggagagcttcaacgccgtgcaggactggagcacccagatcaagacctacagctgggacaacgcccaggtgatcctggtgggcaacaagtgcgacatggaggacgagagagtgatcagcaccgagagaggccagcacctgggcgagcagctgggcttcgagttcttcgagaccagcgccaaggacaacatcaacgtgaagcagaccttcgagagactggtggacatcatctgcgacaagatgagcgagagcctggagaccgaccccgccatcaccgccgccaagcagaacaccagactgaaggagacccccccccccccccagcccaactgcgcctgctag

SEQ ID NO: 96134 - DNA, 783 bp, Artificial Sequence
  Description of Artificial Sequence: Synthetic coding sequence
atggccggcagccccctgctgtggggccccagagccggcggcgtgggcctgctggtgctgctgctgctgggcctgttcagacccccccccgccctgtgcgccagacccgtgaaggagcccagaggcctgagcgccgccagcccccccctggccgagaccggcgcccccagaagattcagaagaagcgtgcccagaggcgaggccgccggcgccgtgcaggagctggccagagccctggcccacctgctggaggccgagagacaggagagagccagagccgaggcccaggaggccgaggaccagcaggccagagtgctggcccagctgctgagagtgtggggcgcccccagaaacagcgaccccgccctgggcctggacgacgaccccgacgcccccgccgcccagctggccagagccctgctgagagccagactggaccccgccgccctggccgcccagctggtgcccgcccccgtgcccgccgccgccctgagacccagaccccccgtgtacgacgacggccccgccggccccgacgccgaggaggccggcgacgagacccccgacgtggaccccgagctgctgagatacctgctgggcagaatcctggccggcagcgccgacagcgagggcgtggccgcccccagaagactgagaagagccgccgaccacgacgtgggcagcgagctgccccccgagggcgtgctgggcgccctgctgagagtgaagagactggagacccccgccccccaggtgcccgccagaagactgctgcccccctag

SEQ ID NO: 96135 - DNA, 657 bp, Artificial Sequence
  Description of Artificial Sequence: Synthetic coding sequence
atgagccagaccgccatgagcgagacctacgacttcctgttcaagttcctggtgatcggcaacgccggcaccggcaagagctgcctgctgcaccagttcatcgagaagaagttcaaggacgacagcaaccacaccatcggcgtggagttcggcagcaagatcatcaacgtgggcggcaagtacgtgaagctgcagatctgggacaccgccggccaggagagattcagaagcgtgaccagaagctactacagaggcgccgccggcgccctgctggtgtacgacatcaccagcagagagacctacaacgccctgaccaactggctgaccgacgccagaatgctggccagccagaacatcgtgatcatcctgtgcggcaacaagaaggacctggacgccgacagagaggtgaccttcctggaggccagcagattcgcccaggagaacgagctgatgttcctggagaccagcgccctgaccggcgagaacgtggaggaggccttcgtgcagtgcgccagaaagatcctgaacaagatcgagagcggcgagctggaccccgagagaatgggcagcggcatccagtacggcgacgccgccctgagacagctgagaagccccagaagagcccaggcccccaacgcccaggagtgcggctgctag

SEQ ID NO: 96136 - DNA, 648 bp, Artificial Sequence
  Description of Artificial Sequence: Synthetic coding sequence
atggccagcagaggcgccaccagacccaacggccccaacaccggcaacaagatctgccagttcaagctggtgctgctgggcgagagcgccgtgggcaagagcagcctggtgctgagattcgtgaagggccagttccacgagttccaggagagcaccatcggcgccgccttcctgacccagaccgtgtgcctggacgacaccaccgtgaagttcgagatctgggacaccgccggccaggagagataccacagcctggcccccatgtactacagaggcgcccaggccgccatcgtggtgtacgacatcaccaacgaggagagcttcgccagagccaagaactgggtgaaggagctgcagagacaggccagccccaacatcgtgatcgccctgagcggcaacaaggccgacctggccaacaagagagccgtggacttccaggaggcccagagctacgccgacgacaacagcctgctgttcatggagaccagcgccaagaccagcatgaacgtgaacgagatcttcatggccatcgccaagaagctgcccaagaacgagccccagaaccccggcgccaacagcgccagaggcagaggcgtggacctgaccgagcccacccagcccaccagaaaccagtgctgcagcaactag

SEQ ID NO: 96137 - DNA, 606 bp, Artificial Sequence
  Description of Artificial Sequence: Synthetic coding sequence
atggccagcagaggcgccaccagacccaacggccccaacaccggcaacaagatctgccagttcaagctggtgctgctgggcgagagcgccgtgggcaagagcagcctggtgctgagattcgtgaagggccagttccacgagttccaggagagcaccatcggcgtgaagttcgagatctgggacaccgccggccaggagagataccacagcctggcccccatgtactacagaggcgcccaggccgccatcgtggtgtacgacatcaccaacgaggagagcttcgccagagccaagaactgggtgaaggagctgcagagacaggccagccccaacatcgtgatcgccctgagcggcaacaaggccgacctggccaacaagagagccgtggacttccaggaggcccagagctacgccgacgacaacagcctgctgttcatggagaccagcgccaagaccagcatgaacgtgaacgagatcttcatggccatcgccaagaagctgcccaagaacgagccccagaaccccggcgccaacagcgccagaggcagaggcgtggacctgaccgagcccacccagcccaccagaaaccagtgctgcagcaactag

SEQ ID NO: 96138 - DNA, 48 bp, Artificial Sequence
  Description of Artificial Sequence: Synthetic coding sequence
atggccagcagaggcgccaccagacccaacggccccaacaccggctag

SEQ ID NO: 96139 - DNA, 648 bp, Artificial Sequence
  Description of Artificial Sequence: Synthetic coding sequence
atgaccagcagaagcaccgccagacccaacggccagccccaggccagcaagatctgccagttcaagctggtgctgctgggcgagagcgccgtgggcaagagcagcctggtgctgagattcgtgaagggccagttccacgagtaccaggagagcaccatcggcgccgccttcctgacccagagcgtgtgcctggacgacaccaccgtgaagttcgagatctgggacaccgccggccaggagagataccacagcctggcccccatgtactacagaggcgcccaggccgccatcgtggtgtacgacatcaccaaccaggagaccttcgccagagccaagacctgggtgaaggagctgcagagacaggccagccccagcatcgtgatcgccctggccggcaacaaggccgacctggccaacaagagaatggtggagtacgaggaggcccaggcctacgccgacgacaacagcctgctgttcatggagaccagcgccaagaccgccatgaacgtgaacgacctgttcctggccatcgccaagaagctgcccaagagcgagccccagaacctgggcggcgccgccggcagaagcagaggcgtggacctgcacgagcagagccagcagaacaagagccagtgctgcagcaactag

SEQ ID NO: 96140 - DNA, 525 bp, Artificial Sequence
  Description of Artificial Sequence: Synthetic coding sequence
atgaccagcagaagcaccgccagacccaacggccagccccaggccagcaagatctgccagttcaagctggtgctgctgggcgagagcgccgtgggcaagagcagcctggtgctgagattcgtgaagggccagttccacgagtaccaggagagcaccatcggcgccgccttcctgacccagagcgtgtgcctggacgacaccaccgtgaagttcgagatctgggacaccgccggccaggagagataccacagcctggcccccatgtactacagaggcgcccaggccgccatcgtggtgtacgacatcaccaaccaggaggcccaggcctacgccgacgacaacagcctgctgttcatggagaccagcgccaagaccgccatgaacgtgaacgacctgttcctggccatcgccaagaagctgcccaagagcgagccccagaacctgggcggcgccgccggcagaagcagaggcgtggacctgcacgagcagagccagcagaacaagagccagtgctgcagcaactag

SEQ ID NO: 96141 - DNA, 348 bp, Artificial Sequence
  Description of Artificial Sequence: Synthetic coding sequence
atgaccagcagaagcaccgccagacccaacggccagccccaggccagcaagatctgccagttcaagctggtgctgctgggcgagagcgccgtgggcaagagcagcctggtgctgagattcgtgaagggccagttccacgagtaccaggagagcaccatcggcgccgccttcctgacccagagcgtgtgcctggacgacaccaccgtgaagttcgagatctgggacaccgccggccaggagagataccacagcctggcccccatgtactacagaggcgcccaggccgccatcgtggtgtacgacatcaccaaccaggagaccttcgccagagccaagacctgggtgtag

SEQ ID NO: 96142 - DNA, 303 bp, Artificial Sequence
  Description of Artificial Sequence: Synthetic coding sequence
atgaccagcagaagcaccgccagacccaacggccagccccaggccagcaagatctgccagttcaagctggtgctgctgggcgagagcgccgtgggcaagagcagcctggtgctgagattcgtgaagggccagttccacgagtaccaggagagcaccatcggcgccgccttcctgacccagagcgtgtgcctggacgacaccaccgtgaagttcgagatctgggacaccgccggccaggagagataccacagcctggcccccatgtactacagaggcgcccaggccgccatcgtggtgtactag

SEQ ID NO: 96143 - DNA, 648 bp, Artificial Sequence; identical to SEQ ID NO: 96139
  Description of Artificial Sequence: Synthetic coding sequence

SEQ ID NO: 96144 - DNA, 651 bp, Artificial Sequence
  Description of Artificial Sequence: Synthetic coding sequence
atggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctgggacaccgccggccaggagagataccacagcctggcccccatgtactacagaggcgcccaggccgccatcgtggtgtacgacatcaccaacaccgacaccttcgccagagccaagaactgggtgaaggagctgcagagacaggccagccccaacatcgtgatcgccctggccggcaacaaggccgacctggccagcaagagagccgtggagttccaggaggcccaggcctacgccgacgacaacagcctgctgttcatggagaccagcgccaagaccgccatgaacgtgaacgagatcttcatggccatcgccaagaagctgcccaagaacgagccccagaacgccaccggcgcccccggcagaaacagaggcgtggacctgcaggagaacaaccccgccagcagaagccagtgctgcagcaactag

SEQ ID NO: 96145 - DNA, 651 bp, Artificial Sequence; identical to SEQ ID NO: 96144
  Description of Artificial Sequence: Synthetic coding sequence

SEQ ID NO: 96146 - DNA, 750 bp, Artificial Sequence
  Description of Artificial Sequence: Synthetic coding sequence
atggagctgagctggagaagccccagccccctgagcgccagcctgcacagcaccagcccccacccccacgccctgtggaccaccaccgccggcagagccatggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctgggacaccgccggccaggagagataccacagcctggcccccatgtactacagaggcgcccaggccgccatcgtggtgtacgacatcaccaacaccgacaccttcgccagagccaagaactgggtgaaggagctgcagagacaggccagccccaacatcgtgatcgccctggccggcaacaaggccgacctggccagcaagagagccgtggagttccaggaggcccaggcctacgccgacgacaacagcctgctgttcatggagaccagcgccaagaccgccatgaacgtgaacgagatcttcatggccatcgccaagaagctgcccaagaacgagccccagaacgccaccggcgcccccggcagaaacagaggcgtggacctgcaggagaacaaccccgccagcagaagccagtgctgcagcaactag

SEQ ID NO: 96147 - DNA, 225 bp, Artificial Sequence
  Description of Artificial Sequence: Synthetic coding sequence
atggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctag

SEQ ID NO: 96148 - DNA, 279 bp, Artificial Sequence
  Description of Artificial Sequence: Synthetic coding sequence
atggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctgggacaccgccggccaggagagataccacagcctggcccccatgtactacagatag

SEQ ID NO: 96149 - DNA, 375 bp, Artificial Sequence
  Description of Artificial Sequence: Synthetic coding sequence
atggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctgggacaccgccggccaggagagataccacagcctggcccccatgtactacagaggcgcccaggccgccatcgtggtgtacgacatcaccaacaccgacaccttcgccagagccaagaactgggtgaaggagctgcagagacaggccagctag

SEQ ID NO: 96150 - DNA, 627 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccatcagactgcagctgtgggacaccgccggccaggagagattcagaagcctgatccccagctacatcagagacagcgccgccgccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagagaaaggccaaggagctgaacgtgatgttcatcgagaccagcgccaaggccggctacaacgtgaagcagctgttcagaagagtggccgccgccctgcccggcatggagagcacccaggacagaagcagagaggacatgatcgacatcaagctggagaagccccaggagcagcccgtgagcgagggcggctgcagctgctag

SEQ ID NO: 96151 - DNA, 627 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccgtgagactgcagctgtgggacaccgccggccaggagagattcagaagcctgatccccagctacatcagagacagcaccgtggccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagagaaaggccaaggagctgaacgtgatgttcatcgagaccagcgccaaggccggctacaacgtgaagcagctgttcagaagagtggccgccgccctgcccggcatggagagcacccaggacagaagcagagaggacatgatcgacatcaagctggagaagccccaggagcagcccgtgagcgagggcggctgcagctgctag

SEQ ID NO: 96152 - DNA, 627 bp, Artificial Sequence; identical to SEQ ID NO: 96150
  Description of Artificial Sequence: Synthetic coding sequence

SEQ ID NO: 96153 - DNA, 525 bp, Artificial Sequence
  Description of Artificial Sequence: Synthetic coding sequence
tgacccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccgtgagactgcagctgtgggacaccgccggccaggagagattcagaagcctgatccccagctacatcagagacagcaccgtggccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagagaaaggccaaggagctgaacgtgatgttcatcgagaccagcgccaaggccggctacaacgtgaagcagagaatcggcagctgccacgtggcccaggccagcctggagctgctggacagctag

SEQ ID NO: 96154 - DNA, 225 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccgtgagactgcagctgtgggacaccgccggccaggagagatag

SEQ ID NO: 96155 - DNA, 528 bp, Artificial Sequence
  Description of Artificial Sequence: Synthetic coding sequence
atgtacgacagcttcgacaacacctaccaggccaccatcggcatcgacttcctgagcaagaccatgtacctggaggacagaaccatcagactgcagctgtgggacaccgccggccaggagagattcagaagcctgatccccagctacatcagagacagcgccgccgccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagagaaaggccaaggagctgaacgtgatgttcatcgagaccagcgccaaggccggctacaacgtgaagcagctgttcagaagagtggccgccgccctgcccggcatggagagcacccaggacagaagcagagaggacatgatcgacatcaagctggagaagccccaggagcagcccgtgagcgagggcggctgcagctgctag

SEQ ID NO: 96156 - DNA, 429 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccatcagactgcagctgtgggacaccgccggccaggagagattcagaagcctgatccccagctacatcagagacagcgccgccgccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagtag

SEQ ID NO: 96157 - DNA, 315 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggcatcgacttcctgagcaagaccatgtacctggaggacagaaccctgttcagaagagtggccgccgccctgcccggcatggagagcacccaggacagaagcagagaggacatgatcgacatcaagctggagaagccccaggagcagcccgtgagcgagggcggctgcagctgctag

SEQ ID NO: 96158 - DNA, 606 bp, Artificial Sequence
  Description of Artificial Sequence: Synthetic coding sequence
tgagtgttccccagaggcctggccctgagaagcgccgacgtggtggaggtgggcaagaccagcctgatcaccagattcatgtacgacagcttcgacaacacctaccaggccaccatcggcatcgacttcctgagcaagaccatgtacctggaggacagaaccatcagactgcagctgtgggacaccgccggccaggagagattcagaagcctgatccccagctacatcagagacagcgccgccgccgtggtggtgtacgacatcaccaacgtgaacagcttccagcagaccaccaagtggatcgacgacgtgagaaccgagagaggcagcgacgtgatcatcatgctggtgggcaacaagaccgacctggccgacaagagacaggtgagcatcgaggagggcgagagaaaggccaaggagctgaacgtgatgttcatcgagaccagcgccaaggccggctacaacgtgaagcagctgttcagaagagtggccgccgccctgcccggcatggagagcacccaggacagaagcagagaggacatgatcgacatcaagctggagaagccccaggagcagcccgtgagcgagggcggctgcagctgctag

SEQ ID NO: 96159 - DNA, 144 bp, Artificial Sequence
  Description of Artificial Sequence: Synthetic coding sequence
atgagcaccggcggcgacttcggcaaccccctgagaaagttcaagctggtgttcctgggcgagcagagcgtgggcaagaccagcctgatcaccagattcatgtacgacagcttcgacaacacctaccaggccaccatcggctag

SEQ ID NO: 96160 - DNA, 765 bp, Artificial Sequence
  Description of Artificial Sequence: Synthetic coding sequence
atgagcgccggcggcgacttcggcaaccccctgagaaagttcaagctggtgttcctgggcgagcagagcgtggccaagaccagcctgatcaccagattcagatacgacagcttcgacaacacctaccaggccatcatcggcatcgacttcctgagcaagaccatgtacctggaggacggcaccatcggcctgagactgtgggacaccgccggccaggagagactgagaagcctgatccccagatacatcagagacagcgccgccgccgtggtggtgtacgacatcaccaacgtgaacagcttccagcagaccaccaagtggatcgacgacgtgagaaccgagagaggcagcgacgtgatcatcaccctggtgggcaacagaaccgacctggccgacaagagacaggtgagcgtggaggagggcgagagaaaggccaagggcctgaacgtgaccttcatcgagaccagagccaaggccggctacaacgtgaagcagctgttcagaagagtggccgccgccctgcccggcatggagagcacccaggacggcagcagagaggacatgagcgacatcaagctggagaagccccaggagcagaccgtgagcgagggcggctgcagctgctacagccccatgagcagcagcaccctgccccagaagcccccctacagcttcatcgactgcagcgtgaacatcggcctgaacctgttccccagcctgatcaccttctgcaacagcagcctgctgcccgtgagctggagatag

SEQ ID NO: 96161 - DNA, 612 bp, Artificial Sequence
  Description of Artificial Sequence: Synthetic coding sequence
atgggcagcagagaccacctgttcaaggtgctggtggtgggcgacgccgccgtgggcaagaccagcctggtgcagagatacagccaggacagcttcagcaagcactacaagagcaccgtgggcgtggacttcgccctgaaggtgctgcagtggagcgactacgagatcgtgagactgcagctgtgggacatcgccggccaggagagattcaccagcatgaccagactgtactacagagacgccagcgcctgcgtgatcatgttcgacgtgaccaacgccaccaccttcagcaacagccagagatggaagcaggacctggacagcaagctgaccctgcccaacggcgagcccgtgccctgcctgctgctggccaacaagtgcgacctgagcccctgggccgtgagcagagaccagatcgacagattcagcaaggagaacggcttcaccggctggaccgagaccagcgtgaaggagaacaagaacatcaacgaggccatgagagtgctgatcgagaagatgatgagaaacagcaccgaggacatcatgagcctgagcacccagggcgactacatcaacctgcagaccaagagcagcagctggagctgctgctag

SEQ ID NO: 96162 - DNA, 612 bp, Artificial Sequence; identical to SEQ ID NO: 96161
  Description of Artificial Sequence: Synthetic coding sequence

SEQ ID NO: 96163 - DNA, 612 bp, Artificial Sequence; identical to SEQ ID NO: 96161
  Description of Artificial Sequence: Synthetic coding sequence

SEQ ID NO: 96164 - DNA, 396 bp, Artificial Sequence
  Description of Artificial Sequence: Synthetic coding sequence
atgaccagactgtactacagagacgccagcgcctgcgtgatcatgttcgacgtgaccaacgccaccaccttcagcaacagccagagatggaagcaggacctggacagcaagctgaccctgcccaacggcgagcccgtgccctgcctgctgctggccaacaagtgcgacctgagcccctgggccgtgagcagagaccagatcgacagattcagcaaggagaacggcttcaccggctggaccgagaccagcgtgaaggagaacaagaacatcaacgaggccatgagagtgctgatcgagaagatgatgagaaacagcaccgaggacatcatgagcctgagcacccagggcgactacatcaacctgcagaccaagagcagcagctggagctgctgctag

SEQ ID NO: 96165 - DNA, 540 bp, Artificial Sequence
  Description of Artificial Sequence: Synthetic coding sequence
atgggcagcagagaccacctgttcaaggtgctggtggtgggcgacgccgccgtgggcaagaccagcctggtgcagagatacagccaggacagcttcagcaagcactacaagagcaccgtgggcggccaggagagattcaccagcatgaccagactgtactacagagacgccagcgcctgcgtgatcatgttcgacgtgaccaacgccaccaccttcagcaacagccagagatggaagcaggacctggacagcaagctgaccctgcccaacggcgagcccgtgccctgcctgctgctggccaacaagtgcgacctgagcccctgggccgtgagcagagaccagatcgacagattcagcaaggagaacggcttcaccggctggaccgagaccagcgtgaaggagaacaagaacatcaacgaggccatgagagtgctgatcgagaagatgatgagaaacagcaccgaggacatcatgagcctgagcacccagggcgactacatcaacctgcagaccaagagcagcagctggagctgctgctag

SEQ ID NO: 96166 - DNA, 624 bp, Artificial Sequence
  Description of Artificial Sequence: Synthetic coding sequence
atggccaagacctacgactacctgttcaagctgctgctgatcggcgacagcggcgtgggcaagacctgcgtgctgttcagattcagcgaggacgccttcaacagcaccttcatcagcaccatcggcatcgacttcaagatcagaaccatcgagctggacggcaagagaatcaagctgcagatctgggacaccgccggccaggagagattcagaaccatcaccaccgcctactacagaggcgccatgggcatcatgctggtgtacgacatcaccaacgagaagagcttcgacaacatcagaaactggatcagaaacatcgaggagcacgccagcgccgacgtggagaagatgatcctgggcaacaagtgcgacgtgaacgacaagagacaggtgagcaaggagagaggcgagaagctggccctggactacggcatcaagttcatggagaccagcgccaaggccaacatcaacgtggagaacgccttcttcaccctggccagagacatcaaggccaagatggacaagaagctggagggcaacagcccccagggcagcaaccagggcgtgaagatcacccccgaccagcagaagagaagcagcttcttcagatgcgtgctgctgtag

SEQ ID NO: 96167 - DNA, 606 bp, Artificial Sequence
  Description of Artificial Sequence: Synthetic coding sequence
atgagcggcaagagcctgctgctgaaggtgatcctgctgggcgacggcggcgtgggcaagagcagcctgatgaacagatacgtgaccaacaagttcgacagccaggccttccacaccatcggcgtggagttcctgaacagagacctggaggtggacggcagattcgtgaccctgcagatctgggacaccgccggccaggagagattcaagagcctgagaacccccttctacagaggcgccgactgctgcctgctgaccttcagcgtggacgacagacagagcttcgagaacctgggcaactggcagaaggagttcatctactacgccgacgtgaaggaccccgagcacttccccttcgtggtgctgggcaacaaggtggacaaggaggacagacaggtgaccaccgaggaggcccagacctggtgcatggagaacggcgactacccctacctggagaccagcgccaaggacgacaccaacgtgaccgtggccttcgaggaggccgtgagacaggtgctggccgtggaggagcagctggagcactgcatgctgggccacaccatcgacctgaacagcggcagcaaggccggcagcagctgctgctag

SEQ ID NO: 96168 - DNA, 2589 bp, Artificial Sequence
  Description of Artificial Sequence: Synthetic coding sequence
atggcccagcccggccccgccagccagcccgacgtgagcctgcagcagagagtggccgagctggagaagatcaacgccgagttcctgagagcccagcagcagctggagcaggagttcaaccagaagagagccaagttcaaggagctgtacctggccaaggaggaggacctgaagagacagaacgccgtgctgcaggccgcccaggacgacctgggccacctgagaacccagctgtgggaggcccaggccgagatggagaacatcaaggccatcgccaccgtgagcgagaacaccaagcaggaggccatcgacgaggtgaagagacagtggagagaggaggtggccagcctgcaggccgtgatgaaggagaccgtgagagactacgagcaccagttccacctgagactggagcaggagagaacccagtgggcccagtacagagagagcgccgagagagagatcgccgacctgagaagaagactgagcgagggccaggaggaggagaacctggagaacgagatgaagaaggcccaggaggacgccgagaagctgagaagcgtggtgatgcccatggagaaggagatcgccgccctgaaggacaagctgaccgaggccgaggacaagatcaaggagctggaggccagcaaggtgaaggagctgaaccactacctggaggccgagaagagctgcagaaccgacctggagatgtacgtggccgtgctgaacacccagaagagcgtgctgcaggaggacgccgagaagctgagaaaggagctgcacgaggtgtgccacctgctggagcaggagagacagcagcacaaccagctgaagcacacctggcagaaggccaacgaccagttcctggagagccagagactgctgatgagagacatgcagagaatggagatcgtgctgaccagcgagcagctgagacaggtggaggagctgaagaagaaggaccaggaggacgacgagcagcagagactgaacaagagaaaggaccacaagaaggccgacgtggaggaggagatcaagatccccgtggtgtgcgccctgacccaggaggagagcagcgcccagctgagcaacgaggaggagcacctggacagcaccagaggcagcgtgcacagcctggacgccggcctgctgctgcccagcggcgaccccttcagcaagagcgacaacgacatgttcaaggacggcctgagaagagcccagagcaccgacagcctgggcaccagcggcagcctgcagagcaaggccctgggctacaactacaaggccaagagcgccggcaacctggacgagagcgacttcggccccctggtgggcgccgacagcgtgagcgagaacttcgacaccgccagcctgggcagcctgcagatgcccagcggcttcatgctgaccaaggaccaggagagagccatcaaggccatgacccccgagcaggaggagaccgccagcctgctgagcagcgtgacccagggcatggagagcgcctacgtgagccccagcggctacagactggtgagcgagaccgagtggaacctgctgcagaaggaggtgcacaacgccggcaacaagctgggcagaagatgcgacatgtgcagcaactacgagaagcagctgcagggcatccagatccaggaggccgagaccagagaccaggtgaagaagctgcagctgatgctgagacaggccaacgaccagctggagaagaccatgaaggacaagcaggagctggaggacttcatcaagcagagcagcgaggacagcagccaccagatcagcgccctggtgctgagagcccaggccagcgagatcctgctggaggagctgcagcagggcctgagccaggccaagagagacgtgcaggagcagatggccgtgctgatgcagagcagagagcaggtgagcgaggagctggtgagactgcagaaggacaacgacagcctgcagggcaagcacagcctgcacgtgagcctgcagcaggccgaggacttcatcctgcccgacaccaccgaggccctgagagagctggtgctgaagtacagagaggacatcatcaacgtgagaaccgccgccgaccacgtggaggagaagctgaaggccgagatcctgttcctgaaggagcagatccaggccgagcagtgcctgaaggagaacctggaggagaccctgcagctggagatcgagaactgcaaggaggagatcgccagcatcagcagcctgaaggccgagctggagagaatcaaggtggagaagggccagctggagagcaccctgagagagaagagccagcagctggagagcctgcaggagatcaagatcagcctggaggagcagctgaagaaggagaccgccgccaaggccaccgtggagcagctgatgttcgaggagaagaacaaggcccagagactgcagaccgagctggacgtgagcgagcaggtgcagagagacttcgtgaagctgagccagaccctgcaggtgcagctggagagaatcagacaggccgacagcctggagagaatcagagccatcctgaacgacaccaagctgaccgacatcaaccagctgcccgagacctag

SEQ ID NO: 96169 - DNA, 2490 bp, Artificial Sequence
  Description of Artificial Sequence: Synthetic coding sequence
atggcccagcccggccccgccagccagcccgacgtgagcctgcagcagagagtggccgagctggagaagatcaacgccgagttcctgagagcccagcagcagctggagcaggagttcaaccagaagagagccaagttcaaggagctgtacctggccaaggaggaggacctgaagagacagaacgccgtgctgcaggccgcccaggacgacctgggccacctgagaacccagctgtgggaggcccaggccgagatggagaacatcaaggccatcgccaccgtgagcgagaacaccaagcaggaggccatcgacgaggtgaagagacagtggagagaggaggtggccagcctgcaggccgtgatgaaggagaccgtgagagactacgagcaccagttccacctgagactggagcaggagagaacccagtgggcccagtacagagagagcgccgagagagagatcgccgacctgagaagaagactgagcgagggccaggaggaggagaacctggagaacgagatgaagaaggcccaggaggacgccgagaagctgagaagcgtggtgatgcccatggagaaggagatcgccgccctgaaggacaagctgaccgaggccgaggacaagatcaaggagctggaggccagcaaggtgaaggagctgaaccactacctggaggccgagaagagctgcagaaccgacctggagatgtacgtggccgtgctgaacacccagaagagcgtgctgcaggaggacgccgagaagctgagaaaggagctgcacgaggtgtgccacctgctggagcaggagagacagcagcacaaccagctgaagcacacctggcagaaggccaacgaccagttcctggagagccagagactgctgatgagagacatgcagagaatggagatcgtgctgaccagcgagcagctgagacaggtggaggagctgaagaagaaggaccaggaggacgacgagcagcagagactgaacaagagaaaggaccacaagaaggccgacgtggaggaggagatcaagatccccgtggtgtgcgccctgacccaggaggagagcagcgcccagctgagcaacgaggaggagcacctggacagcaccagaggcagcgtgcacagcctggacgccggcctgctgctgcccagcggcgaccccttcagcaagagcgacaacgacatgttcaaggacggcctgagaagagcccagagcaccgacagcctgggcaccagcggcagcctgcagagcaaggccctgggctacaactacaaggccaagagcgccggcaacctggacgagagcgacttcggccccctggtgggcgccgacagcgtgagcgagaacttcgacaccgccagcctgggcagcctgcagatgcccagcggcttcatgctgaccaaggaccaggagagagccatcaaggccatgacccccgagcaggaggagaccgccagcctgctgagcagcgtgacccagggcatggagagcgcctacgtgagccccagcggctacagactggtgagcgagaccgagtggaacctgctgcagaaggaggtgcacaacgccggcaacaagctgggcagaagatgcgacatgtgcagcaactacgagaagcagctgcagggcatccagatccaggaggccgagaccagagaccaggtgaagaagctgcagctgatgctgagacaggccaacgaccagctggagaagaccatgaaggacaagcaggagctggaggacttcatcaagcagagcagcgaggacagcagccaccagatcagcgccctggtgctgagagcccaggccagcgagatcctgctggaggagctgcagcagggcctgagccaggccaagagagacgtgcaggagcagatggccgtgctgatgcagagcagagagcaggtgagcgaggagctggtgagactgcagaaggacaacgacagcctgcagggcaagcacagcctgcacgtgagcctgcagcaggccgaggacttcatcctgcccgacaccaccgaggccctgagagagctggtgctgaagtacagagaggacatcatcaacgtgagaaccgccgccgaccacgtggaggagaagctgaaggccgagatcctgttcctgaaggagcagatccaggccgagcagtgcctgaaggagaacctggaggagaccctgcagctggagatcgagaactgcaaggaggagatcgccagcatcagcagcctgaaggccgagctggagagaatcaaggtggagaagggccaggccaccgtggagcagctgatgttcgaggagaagaacaaggcccagagactgcagaccgagctggacgtgagcgagcaggtgcagagagacttcgtgaagctgagccagaccctgcaggtgcagctggagagaatcagacaggccgacagcctggagagaatcagagccatcctgaacgacaccaagctgaccgacatcaaccagctgcccgagacctag

SEQ ID NO: 96170 - DNA, 2490 bp, Artificial Sequence; identical to SEQ ID NO: 96169
  Description of Artificial Sequence: Synthetic coding sequence

SEQ ID NO: 96171 - DNA, 2460 bp, Artificial Sequence
  Description of Artificial Sequence: Synthetic coding sequence
atggcccagcccggccccgccagccagcccgacgaggacctgaagagacagaacgccgtgctgcaggccgcccaggacgacctgggccacctgagaacccagctgtgggaggcccaggccgagatggagaacatcaaggccatcgccaccgtgagcgagaacaccaagcaggaggccatcgacgaggtgaagagacagtggagagaggaggtggccagcctgcaggccgtgatgaaggagaccgtgagagactacgagcaccagttccacctgagactggagcaggagagaacccagtgggcccagtacagagagagcgccgagagagagatcgccgacctgagaagaagactgagcgagggccaggaggaggagaacctggagaacgagatgaagaaggcccaggaggacgccgagaagctgagaagcgtggtgatgcccatggagaaggagatcgccgccctgaaggacaagctgaccgaggccgaggacaagatcaaggagctggaggccagcaaggtgaaggagctgaaccactacctggaggccgagaagagctgcagaaccgacctggagatgtacgtggccgtgctgaacacccagaagagcgtgctgcaggaggacgccgagaagctgagaaaggagctgcacgaggtgtgccacctgctggagcaggagagacagcagcacaaccagctgaagcacacctggcagaaggccaacgaccagttcctggagagccagagactgctgatgagagacatgcagagaatggagatcgtgctgaccagcgagcagctgagacaggtggaggagctgaagaagaaggaccaggaggacgacgagcagcagagactgaacaagagaaaggaccacaagaaggccgacgtggaggaggagatcaagatccccgtggtgtgcgccctgacccaggaggagagcagcgcccagctgagcaacgaggaggagcacctggacagcaccagaggcagcgtgcacagcctggacgccggcctgctgctgcccagcggcgaccccttcagcaagagcgacaacgacatgttcaaggacggcctgagaagagcccagagcaccgacagcctgggcaccagcggcagcctgcagagcaaggccctgggctacaactacaaggccaagagcgccggcaacctggacgagagcgacttcggccccctggtgggcgccgacagcgtgagcgagaacttcgacaccgccagcctgggcagcctgcagatgcccagcggcttcatgctgaccaaggaccaggagagagccatcaaggccatgacccccgagcaggaggagaccgccagcctgctgagcagcgtgacccagggcatggagagcgcctacgtgagccccagcggctacagactggtgagcgagaccgagtggaacctgctgcagaaggaggtgcacaacgccggcaacaagctgggcagaagatgcgacatgtgcagcaactacgagaagcagctgcagggcatccagatccaggaggccgagaccagagaccaggtgaagaagctgcagctgatgctgagacaggccaacgaccagctggagaagaccatgaaggacaagcaggagctggaggacttcatcaagcagagcagcgaggacagcagccaccagatcagcgccctggtgctgagagcccaggccagcgagatcctgctggaggagctgcagcagggcctgagccaggccaagagagacgtgcaggagcagatggccgtgctgatgcagagcagagagcaggtgagcgaggagctggtgagactgcagaaggacaacgacagcctgcagggcaagcacagcctgcacgtgagcctgcagcaggccgaggacttcatcctgcccgacaccaccgaggccctgagagagctggtgctgaagtacagagaggacatcatcaacgtgagaaccgccgccgaccacgtggaggagaagctgaaggccgagatcctgttcctgaaggagcagatccaggccgagcagtgcctgaaggagaacctggaggagaccctgcagctggagatcgagaactgcaaggaggagatcgccagcatcagcagcctgaaggccgagctggagagaatcaaggtggagaagggccagctggagagcaccctgagagagaagagccagcagctggagagcctgcaggagatcaagatcagcctggaggagcagctgaagaaggagaccgccgccaaggccaccgtggagcagctgatgttcgaggagaagaacaaggcccagagactgcagaccgagctggacgtgagcgagcaggtgcagagagacttcgtgaagctgagccagaccctgcaggtgcagctggagagaatcagacaggccgacagcctggagagaatcagagccatcctgaacgacaccaagctgaccgacatcaaccagctgcccgagacctag

SEQ ID NO: 96172 - DNA, 2151 bp, Artificial Sequence
  Description of Artificial Sequence: Synthetic coding sequence
atggcccagcccggccccgccagccagcccgacgtgagcctgcagcagagagtggccgagctggagaagatcaacgccgagttcctgagagcccagcagcagctggagcaggagttcaaccagaagagagccaagttcaaggagctgtacctggccaaggaggaggacctgaagagacagaacgccgtgctgcaggccgcccaggacgacctgggccacctgagaacccagctgtgggaggcccaggccgagatggagaacatcaaggccatcgccaccgtgagcgagaacaccaagcaggaggccatcgacgaggtgaagagacagtggagagaggaggtggccagcctgcaggccgtgatgaaggagaccgtgagagactacgagcaccagttccacctgagactggagcaggagagaacccagtgggcccagtacagagagagcgccgagagagagatcgccgacctgagaagaagactgagcgagggccaggaggaggagaacctggagaacgagatgaagaaggcccaggaggacgccgagaagctgagaagcgtggtgatgcccatggagaaggagatcgccgccctgaaggacaagctgaccgaggccgaggacaagatcaaggagctggaggccagcaaggtgaaggagctgaaccactacctggaggccgagaagagctgcagaaccgacctggagatgtacgtggccgtgctgaacacccagaagagcgtgctgcaggaggacgccgagaagctgagaaaggagctgcaccaggagagacagcagcacaaccagctgaagcacacctggcagaaggccaacgaccagttcctggagagccagagactgctgatgagagacatgcagagaatggagatcgtgctgaccagcgagcagctgagacaggtggaggagctgaagaagaaggaccaggaggacgacgagcagcagagactgaacaagagaaaggaccacaagaaggccgacgtggaggaggagatcaagatccccgtggtgtgcgccctgacccaggaggagagcagcgcccagctgagcaacgaggaggagcacctggacagcaccagaggcagcgtgcacagcctggacgccggcctgctgctgcccagcggcgaccccttcagcaagagcgacaacgacatgttcaaggacggcctgagaagagcccagagcaccgacagcctgggcaccagcggcagcctgcagagcaaggccctgggctacaactacaaggccaagagcgccggcaacctggacgagagcgacttcggccccctggtgggcgccgacagcgtgagcgagaacttcgacaccgccagcctgggcagcctgcagatgcccagcggcttcatgctgaccaaggaccaggagagagccatcaaggccatgacccccgagcaggaggagaccgccagcctgctgagcagcgtgacccagggcatggagagcgcctacgtgagccccagcggctacagactggtgagcgagaccgagtggaacctgctgcagaaggaggtgcacaacgccggcaacaagctgggcagaagatgcgacatgtgcagcaactacgagaagcagctgcagggcatccagatccaggaggccgagaccagagaccaggtgaagaagctgcagctgatgctgagacaggccaacgaccagctggagaagaccatgaaggacaagcaggagctggaggacttcatcaagcagagcagcgaggacagcagccaccagatcagcgccctggtgctgagagcccaggccagcgagatcctgctggaggagctgcagcagggcctgagccaggccaagagagacgtgcaggagcagatggccgtgctgatgcagagcagagagcaggtgagcgaggagctggtgagactgcagaaggacaacgacagcctgcagggcaagcacagcctgcacgtgagcctgcagcaggccgaggacttcatcctgcccgacaccaccgaggccctgagagagctggtgctgaagtacagagaggacatcatcaacgtgagaaccgccgccgaccacgtggaggagaagctgaaggccgagatcctgttcctgaaggagcagatccaggccgagcagtgcctgaagaagaagaagtag

SEQ ID NO: 96173 - DNA, 2589 bp, Artificial Sequence; identical to SEQ ID NO: 96168
  Description of Artificial Sequence: Synthetic coding sequence

SEQ ID NO: 96174 - DNA, 1602 bp, Artificial Sequence
  Description of Artificial Sequence: Synthetic coding sequence
atggccgccgccgcccccgtggccgccgacgacgacgagagaagaagaagacccggcgccgccctggaggacagcagaagccaggagggcgccaacggcgaggccgagagcggcgagctgagcagactgagagccgagctggccggcgccctggccgagatggagaccatgaaggccgtggccgaggtgagcgagagcaccaaggccgaggccgtggccgccgtgcagagacagtgccaggaggaggtggccagcctgcaggccatcctgaaggacagcatcagcagctacgaggcccagatcaccgccctgaagcaggagagacagcagcagcagcaggactgcgaggagaaggagagagagctgggcagactgaagcagctgctgagcagagcctaccccctggacagcctggagaagcagatggagaaggcccacgaggacagcgagaagctgagagagatcgtgctgcccatggagaaggagatcgaggagctgaaggccaagctgctgagagccgaggagctgatccaggagatccagagaagacccagacacgcccccagcctgcacggcagcaccgagctgctgcccctgagcagagaccccagcccccccctggagcccctggaggagctgagcggcgacggcggccccgccgccgaggccttcgcccacaactgcgacgacagcgccagcatcagcagcttcagcctgggcggcggcgtgggcagcagcagcagcctgccccagagcagacagggcctgagccccgagcaggaggagaccgccagcctggtgagcaccggcaccctggtgcccgagggcatctacctgcccccccccggctaccagctggtgcccgacacccagtgggagcagctgcagaccgagatgcaggtgctgctggcccaggtgcagaacagcgagcagctgctgagaaccctgcagggcaccgtgagccaggcccaggagagagtgcagctgcagatggccgagctggtgaccacccacaagtgcctgcaccacgaggtgaagagactgaacgaggagaaccagggcctgagagccgagcagctgcccagcagcgccccccagggcagccagcaggagcagggcgaggaggagagcctgcccagcagcgtgcccgagctgcagcagctgctgtgctgcaccagacaggaggccagagccagactgcaggcccaggagcacggcgccgagagactgagaatcgagatcgtgaccctgagagaggccctggaggaggagaccgtggccagagccagcctggagggccagctgagagtgcagagagaggagaccgccagcctgtgcagcctgagaaccgagatggagagagtgcagcaggagcagagcaaggcccagctgcccgacctgctgagcgagcagagagccaaggtgctgagactgcaggccgagctggagaccagcgagcaggtgcagagagacttcgtgagactgagccaggccctgcaggtgagactggagagaatcagacaggccgagaccctggagcaggtgagaagcatcatggacgaggcccccctgaccgacgtgagagacatcaaggacacctag

SEQ ID NO: 96175 - DNA, 1710 bp, Artificial Sequence
  Description of Artificial Sequence: Synthetic coding sequence
atggccgccgccgcccccgtggccgccgacgacgacgagagaagaagaagacccggcgccgccctggaggacagcagaagccaggagggcgccaacggcgaggccgagagcggcgagctgagcagactgagagccgagctggccggcgccctggccgagatggagaccatgaaggccgtggccgaggtgagcgagagcaccaaggccgaggccgtggccgccgtgcagagacagtgccaggaggaggtggccagcctgcaggccatcctgaaggacagcatcagcagctacgaggcccagatcaccgccctgaagcaggagagacagcagcagcagcaggactgcgaggagaaggagagagagctgggcagactgaagcagctgctgagcagagcctaccccctggacagcctggagaagcagatggagaaggcccacgaggacagcgagaagctgagagagatcgtgctgcccatggagaaggagatcgaggagctgaaggccaagctgctgagagccgaggagctgatccaggagatccagagaagacccagacacgcccccagcctgcacggcagcaccgagctgctgcccctgagcagagaccccagcccccccctggagcccctggaggagctgagcggcgacggcggccccgccgccgaggccttcgcccacaactgcgacgacagcgccagcatcagcagcttcagcctgggcggcggcgtgggcagcagcagcagcctgccccagagcagacagggcctgagccccgagcaggaggagaccgccagcctggtgagcaccggcaccctggtgcccgagggcatctacctgcccccccccggctaccagctggtgcccgacacccagtgggagcagctgcagaccgagggcagacagctgcagaaggacctggagagcgtgagcagagagagagacgagctgcaggagggcctgagaagaagcaacgaggactgcgccaagcagatgcaggtgctgctggcccaggtgcagaacagcgagcagctgctgagaaccctgcagggcaccgtgagccaggcccaggagagagtgcagctgcagatggccgagctggtgaccacccacaagtgcctgcaccacgaggtgaagagactgaacgaggagaaccagggcctgagagccgagcagctgcccagcagcgccccccagggcagccagcaggagcagggcgaggaggagagcctgcccagcagcgtgcccgagctgcagcagctgctgtgctgcaccagacaggaggccagagccagactgcaggcccaggagcacggcgccgagagactgagaatcgagatcgtgaccctgagagaggccctggaggaggagaccgtggccagagccagcctggagggccagctgagagtgcagagagaggagaccgaggtgctggaggccagcctgtgcagcctgagaaccgagatggagagagtgcagcaggagcagagcaaggcccagctgcccgacctgctgagcgagcagagagccaaggtgctgagactgcaggccgagctggagaccagcgagcaggtgcagagagacttcgtgagactgagccaggccctgcaggtgagactggagagaatcagacaggccgagaccctggagcaggtgagaagcatcatggacgaggcccccctgaccgacgtgagagacatcaaggacacctag

SEQ ID NO: 96176 - DNA, 1497 bp, Artificial Sequence
  Description of Artificial Sequence: Synthetic coding sequence
atggccgccgccgcccccgtggccgccgacgacgacgagagaagaagaagacccggcgccgacagcatcagcagctacgaggcccagatcaccgccctgaagcaggagagacagcagcagcagcaggactgcgaggagaaggagagagagctgggcagactgaagcagctgctgagcagagcctaccccctggacagcctggagaagcagatggagaaggcccacgaggacagcgagaagctgagagagatcgtgctgcccatggagaaggagatcgaggagctgaaggccaagctgctgagagccgaggagctgatccaggagatccagagaagacccagacacgcccccagcctgcacggcagcaccgagctgctgcccctgagcagagaccccagcccccccctggagcccctggaggagctgagcggcgacggcggccccgccgccgaggccttcgcccacaactgcgacgacagcgccagcatcagcagcttcagcctgggcggcggcgtgggcagcagcagcagcctgccccagagcagacagggcctgagccccgagcaggaggagaccgccagcctggtgagcaccggcaccctggtgcccgagggcatctacctgcccccccccggctaccagctggtgcccgacacccagtgggagcagctgcagaccgagggcagacagctgcagaaggacctggagagcgtgagcagagagagagacgagctgcaggagggcctgagaagaagcaacgaggactgcgccaagcagatgcaggtgctgctggcccaggtgcagaacagcgagcagctgctgagaaccctgcagggcaccgtgagccaggcccaggagagagtgcagctgcagatggccgagctggtgaccacccacaagtgcctgcaccacgaggtgaagagactgaacgaggagaaccagggcctgagagccgagcagctgcccagcagcgccccccagggcagccagcaggagcagggcgaggaggagagcctgcccagcagcgtgcccgagctgcagcagctgctgtgctgcaccagacaggaggccagagccagactgcaggcccaggagcacggcgccgagagactgagaatcgagatcgtgaccctgagagaggccctggaggaggagaccgtggccagagccagcctggagggccagctgagagtgcagagagaggagaccgaggtgctggaggccagcctgtgcagcctgagaaccgagatggagagagtgcagcaggagcagagcaaggcccagctgcccgacctgctgagcgagcagagagccaaggtgctgagactgcaggccgagctggagaccagcgagcaggtgcagagagacttcgtgagactgagccaggccctgcaggtgagactggagagaatcagacaggccgagaccctggagcaggtgagaagcatcatggacgaggcccccctgaccgacgtgagagacatcaaggacacctag

SEQ ID NO: 96177 - DNA, 2085 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgcacagcgtgtggctgtgcaagatctgcatcgagcagagagaggtgtggaagagaagcggcgcctggttcttcaagggcttccccaagcaggtgctgccccagcccatgcccatcaagaagaccaagccccagcagcccgtgagcgagcccgccgcccccgagcagcccgcccccgagcccaagcaccccgccagagcccccgccagaggcgacagcgaggacagaagaggccccggccagaagaccggccccgaccccgccagcgcccccggcagaggcaactacggcccccccgtgagaagagccagcgaggccagaatgagcagcagcagcagagacagcgagagctgggaccacagcggcggcgccggcgacagcagcagaagccccgccggcctgagaagagccaacagcgtgcaggccagcagacccgcccccggcagcgtgcagagccccgcccccccccagcccggccagcccggcacccccggcggcagcagacccggccccggccccgccggcagattccccgaccagaagcccgaggtggcccccagcgaccccggcaccaccgccccccccagagaggagagaaccggcggcgtgggcggctaccccgccgtgggcgccagagaggacagaatgagccaccccagcggcccctacagccaggccagcgccgccgccccccagcccgccgccgccagacagccccccccccccgaggaggaggaggaggaggccaacagctacgacagcgacgaggccaccaccctgggcgccctggagttcagcctgctgtacgaccaggacaacagcagcctgcagtgcaccatcatcaaggccaagggcctgaagcccatggacagcaacggcctggccgacccctacgtgaagctgcacctgctgcccggcgccagcaagagcaacaagctgagaaccaagaccctgagaaacaccagaaaccccatctggaacgagaccctggtgtaccacggcatcaccgacgaggacatgcagagaaagaccctgagaatcagcgtgtgcgacgaggacaagttcggccacaacgagttcatcggcgagaccagattcagcctgaagaagctgaagcccaaccagagaaagaacttcaacatctgcctggagagagtgatccccatgaagagagccggcaccaccggcagcgccagaggcatggccctgtacgaggaggagcaggtggagagagtgggcgacatcgaggagagaggcaagatcctggtgagcctgatgtacagcacccagcagggcggcctgatcgtgggcatcatcagatgcgtgcacctggccgccatggacgccaacggctacagcgaccccttcgtgaagctgtggctgaagcccgacatgggcaagaaggccaagcacaagacccagatcaagaagaagaccctgaaccccgagttcaacgaggagttcttctacgacatcaagcacagcgacctggccaagaagagcctggacatcagcgtgtgggactacgacatcggcaagagcaacgactacatcggcggctgccagctgggcatcagcgccaagggcgagagactgaagcactggtacgagtgcctgaagaacaaggacaagaagatcgagagatggcaccagctgcagaacgagaaccacgtgagcagcgactag

SEQ ID NO: 96178 - DNA, 2085 bp, Artificial Sequence; identical to SEQ ID NO: 96177
  Description of Artificial Sequence: Synthetic coding sequence

SEQ ID NO: 96179 - DNA, 2085 bp, Artificial Sequence; identical to SEQ ID NO: 96177
  Description of Artificial Sequence: Synthetic coding sequence

SEQ ID NO: 96180 - DNA, 1938 bp, Artificial Sequence
  Description of Artificial Sequence: Synthetic coding sequence
atgaccgacaccgtgttcagcaacagcagcaacagatggatgtaccccagcgacagacccctgcagagcaagctgaaggacagaagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgcacagcgtgtggctgtgcaagatctgcatcgagcagagagaggtgtggaagagaagcggcgcctggttcttcaagggcttccccaagcaggtgctgccccagcccatgcccatcaagaagaccaagccccagcagcccgtgagcgagcccgccgcccccgagcagcccgcccccgagcccaagcaccccgccagagcccccgccagaggcgacagcgaggacagaagaggccccggccagaagaccggccccgaccccgccagcgcccccggcagaggcaactacggcccccccgtgagaagagccagcgaggccagaatgagcagcagcagcagagacagcgagagctgggaccacagcggcggcgccggcgacagcagcagaagccccgccggcctgagaagagccaacagcgtgcaggccagcagacccgcccccggcagcgtgcagagccccgcccccccccagcccggccagcccggcacccccggcggcagcagacccggccccggccccgccggcagattccccgaccagaagcccgaggtggcccccagcgaccccggcaccaccgccccccccagagaggagagaaccggcggcgtgggcggctaccccgccgtgggcgccagagaggacagaatgagccaccccagcggcccctacagccaggccagcgccgccgccccccagcccgccgccgccagacagccccccccccccgaggaggaggaggaggaggccaacagctacgacagcgacgaggccaccaccctgggcgccctggagttcagcctgctgtacgaccaggacaacagcagcctgcagtgcaccatcatcaaggccaagggcctgaagcccatggacagcaacggcctggccgacccctacgtgaagctgcacctgctgcccggcgccagcaagagcaacaagctgagaaccaagaccctgagaaacaccagaaaccccatctggaacgagaccctggtgtaccacggcatcaccgacgaggacatgcagagaaagaccctgagaatcagcgtgtgcgacgaggacaagttcggccacaacgagttcatcggcgagaccagattcagcctgaagaagctgaagcccaaccagagaaagaacttcaacatctgcctggagagagtgatccccatgaagagagccggcaccaccggcagcgccagaggcatggccctgtacgaggaggagcaggtggagagagtgggcgacatcgaggagagaggcaagatcctggtgagcctgatgtacagcacccagcagggcggcctgatcgtgggcatcatcagatgcgtgcacctggccgccatggacgccaacggctacagcgaccccttcgtgaagctgtggctgaagcccgacatgggcaagaaggccaagcacaagacccagatcaagaagaagaccctgaaccccgagttcaacgaggagttcttctacgacatcaagcacagcgacctggccaagaagagcctggacatcagcgtgtgggactacgacatcggcaagagcaacgactacatcggcggctgccagctgggcatcagcgccaagggcgagagactgaagcactggtacgagtgcctgaagaacaaggacaagaagatcgagagatggcaccagctgcagaacgagaaccacgtgagcagcgactag

SEQ ID NO: 96181 - DNA, 2085 bp, Artificial Sequence; identical to SEQ ID NO: 96177
  Description of Artificial Sequence: Synthetic coding sequence

SEQ ID NO: 96182 - DNA, 39 bp, Artificial Sequence
  Description of Artificial Sequence: Synthetic coding sequence
atgaccgacaccgtgttcagcaacagcagcaacagatag

SEQ ID NO: 96183 - DNA, 252 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactgtag

SEQ ID NO: 96184 - DNA, 285 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggctag

SEQ ID NO: 96185 - DNA, 492 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgcacagcgtgtggctgtgcaagatctgcatcgagcagagagaggtgtggaagagaagcggcgcctggttcttcaagggcttccccaagtag

SEQ ID NO: 96186 - DNA, 384 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggctag

SEQ ID NO: 96187 - DNA, 315 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagtag

SEQ ID NO: 96188 - DNA, 120 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggctag

SEQ ID NO: 96189 - DNA, 348 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgctag

SEQ ID NO: 96190 - DNA, 2073 bp, Artificial Sequence
  Description of Artificial Sequence: Synthetic coding sequence
atgaccgacaccgtgttcagcaacagcagcaacagatggatgtaccccagcgacagacccctgcagagcaagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgcacagcgtgtggctgtgcaagatctgcatcgagcagagagaggtgtggaagagaagcggcgcctggttcttcaagggcttccccaagcaggtgctgccccagcccatgcccatcaagaagaccaagccccagcagcccgtgagcgagcccgccgcccccgagcagcccgcccccgagcccaagcaccccgccagagcccccgccagaggcgacagcgaggacagaagaggccccggccagaagaccggccccgaccccgccagcgcccccggcagaggcaactacggcccccccgtgagaagagccagcgaggccagaatgagcagcagcagcagagacagcgagagctgggaccacagcggcggcgccggcgacagcagcagaagccccgccggcctgagaagagccaacagcgtgcaggccagcagacccgcccccggcagcgtgcagagccccgcccccccccagcccggccagcccggcacccccggcggcagcagacccggccccggccccgccggcagattccccgaccagaagcccgaggtggcccccagcgaccccggcaccaccgccccccccagagaggagagaaccggcggcgtgggcggctaccccgccgtgggcgccagagaggacagaatgagccaccccagcggcccctacagccaggccagcgccgccgccccccagcccgccgccgccagacagccccccccccccgaggaggaggaggaggaggccaacagctacgacagcgacgaggccaccaccctgggcgccctggagttcagcctgctgtacgaccaggacaacagcagcctgcagtgcaccatcatcaaggccaagggcctgaagcccatggacagcaacggcctggccgacccctacgtgaagctgcacctgctgcccggcgccagcaagagcaacaagctgagaaccaagaccctgagaaacaccagaaaccccatctggaacgagaccctggtgtaccacggcatcaccgacgaggacatgcagagaaagaccctgagaatcagcgtgtgcgacgaggacaagttcggccacaacgagttcatcggcgagaccagattcagcctgaagaagctgaagcccaaccagagaaagaacttcaacatctgcctggagagagtgatccccatgaagagagccggcaccaccggcagcgccagaggcatggccctgtacgaggaggagcaggtggagagagtgggcgacatcgaggagagaggcaagatcctggtgagcctgatgtacagcacccagcagggcggcctgatcgtgggcatcatcagatgcgtgcacctggccgccatggacgccaacggctacagcgaccccttcgtgaagctgtggctgaagcccgacatgggcaagaaggccaagcacaagacccagatcaagaagaagaccctgaaccccgagttcaacgaggagttcttctacgacatcaagcacagcgacctggccaagaagagcctggacatcagcgtgtgggactacgacatcggcaagagcaacgactacatcggcggctgccagctgggcatcagcgccaagggcgagagactgaagcactggtacgagtgcctgaagaacaaggacaagaagatcgagagatggcaccagctgcagaacgagaaccacgtgagcagcgactag

SEQ ID NO: 96191 - DNA, 378 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtag

SEQ ID NO: 96192 - DNA, 546 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgcacagcgtgtggctgtgcaagatctgcatcgagcagagagaggtgtggaagagaagcggcgcctggttcttcaagggcttccccaagcaggtgctgccccagcccatgcccatcaagaagaccaagccccagcagcccgtgtag

SEQ ID NO: 96193 - DNA, 285 bp, Artificial Sequence; identical to SEQ ID NO: 96184
  Description of Artificial Sequence: Synthetic coding sequence

SEQ ID NO: 96194 - DNA, 363 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagtag

SEQ ID NO: 96195 - DNA, 405 bp, Artificial Sequence
  Description of Artificial Sequence: Synthetic coding sequence
atgaccgacaccgtgttcagcaacagcagcaacagatggatgtaccccagcgacagacccctgcagagcaacgacaaggagcagctgcaggccggctggagcgtgcaccccggcggccagcccgacagacagagaaagcaggaggagctgaccgacgaggagaaggagatcatcaacagagtgatcgccagagccgagaagatggaggagatggagcaggagagaatcggcagactggtggacagactggagaacatgagaaagaacgtggccggcgacggcgtgaacagatgcatcctgtgcggcgagcagctgggcatgctgggcagcgcctgcgtggtgtgcgaggactgcaagaagaacgtgtgcaccaagtgcggcgtggagaccaacaacagactgtag

SEQ ID NO: 96196 - DNA, 948 bp, Artificial Sequence
  Description of Artificial Sequence: Synthetic coding sequence
atggccgacaccatcttcggcagcggcaacgaccagtgggtgtgccccaacgacagacagctggccctgagagccaagctgcagaccggctggagcgtgcacacctaccagaccgagaagcagagaagaaagcagcacctgagccccgccgaggtggaggccatcctgcaggtgatccagagagccgagagactggacgtgctggagcagcagagaatcggcagactggtggagagactggagaccatgagaagaaacgtgatgggcaacggcctgagccagtgcctgctgtgcggcgaggtgctgggcttcctgggcagcagcagcgtgttctgcaaggactgcagaaagaaggtgtgcaccaagtgcggcatcgaggccagccccggccagaagagacccctgtggctgtgcaagatctgcagcgagcagagagaggtgtggaagagaagcggcgcctggttctacaagggcctgcccaagtacatcctgcccctgaagacccccggcagagccgacgacccccacttcagacccctgcccaccgagcccgccgagagagagcccagaagcagcgagaccagcagaatctacacctgggccagaggcagagtggtgagcagcgacagcgacagcgacagcgacctgagcagcagcagcctggaggacagactgcccagcaccggcgtgagagacagaaagggcgacaagccctggaaggagagcggcggcagcgtggaggcccccagaatgggcttcacccacccccccggccacctgagcggctgccagagcagcctggccagcggcgagaccggcaccggcagcgccgacccccccggcggccccagacccggcctgaccagaagagcccccgtgaaggacacccccggcagagcccccgccgccgacgccgcccccgccggccccagcagctgcctgggctag

SEQ ID NO: 96197 - DNA, 861 bp, Artificial Sequence
  Description of Artificial Sequence: Synthetic coding sequence
atggccgacaccatcttcggcagcggcaacgaccagtgggtgtgccccaacgacagacagctggccctgagagccaagctgcagaccggctggagcgtgcacacctaccagaccgagaagcagagaagaaagcagcacctgagccccgccgaggtggaggccatcctgcaggtgatccagagagccgagagactggacgtgctggagcagcagagaatcggcagactggtggagagactggagaccatgagaagaaacgtgatgggcaacggcctgagccagtgcctgctgtgcggcgaggtgctgggcttcctgggcagcagcagcgtgttctgcaaggactgcagaaaggtgtggaagagaagcggcgcctggttctacaagggcctgcccaagtacatcctgcccctgaagacccccggcagagccgacgacccccacttcagacccctgcccaccgagcccgccgagagagagcccagaagcagcgagaccagcagaatctacacctgggccagaggcagagtggtgagcagcgacagcgacagcgacagcgacctgagcagcagcagcctggaggacagactgcccagcaccggcgtgagagacagaaagggcgacaagccctggaaggagagcggcggcagcgtggaggcccccagaatgggcttcacccacccccccggccacctgagcggctgccagagcagcctggccagcggcgagaccggcaccggcagcgccgacccccccggcggccccagacccggcctgaccagaagagcccccgtgaaggacacccccggcagagcccccgccgccgacgccgcccccgccggccccagcagctgcctgggctag

SEQ ID NO: 96198 - DNA, 861 bp, Artificial Sequence; identical to SEQ ID NO: 96197
  Description of Artificial Sequence: Synthetic coding sequence

SEQ ID NO: 96199 - DNA, 2331 bp, Artificial Sequence
  Description of Artificial Sequence: Synthetic coding sequence
atgaaccccgaggagcagatcgtgacctggctgatcagcctgggcgtgctggagagccccaagaagaccatctgcgaccccgaggagttcctgaagagcagcctgaagaacggcgtggtgctgtgcaagctgatcaacagactgatgcccggcagcgtggagaagttctgcctggacccccagaccgaggccgactgcatcaacaacatcaacgacttcctgaagggctgcgccaccctgcaggtggagatcttcgaccccgacgacctgtacagcggcgtgaacttcagcaaggtgctgagcaccctgctggccgtgaacaaggccaccgaggaccagctgagcgagagaccctgcggcagaagcagcagcctgagcgccgccaacaccagccagaccaacccccagggcgccgtgagcagcaccgtgagcggcctgcagagacagagcaagaccgtggagatgaccgagaacggcagccaccagctgatcgtgaaggccagattcaacttcaagcagaccaacgaggacgagctgagcgtgtgcaagggcgacatcatctacgtgaccagagtggaggagggcggctggtgggagggcaccctgaacggcagaaccggctggttccccagcaactacgtgagagagatcaagagcagcgagagacccctgagccccaaggccgtgaagggcttcgagaccgcccccctgaccaagaactactacaccgtggtgctgcagaacatcctggacaccgagaaggagtacgccaaggagctgcagagcctgctggtgacctacctgagacccctgcagagcaacaacaacctgagcaccgtggaggtgaccagcctgctgggcaacttcgaggaggtgtgcaccttccagcagaccctgtgccaggccctggaggagtgcagcaagttccccgagaaccagcacaaggtgggcggctgcctgctgagcctgatgccccacttcaagagcatgtacctggcctactgcgccaaccaccccagcgccgtgaacgtgctgacccagcacagcgacgagctggagcagttcatggagaaccagggcgccagcagccccggcatcctgatcctgaccaccaacctgagcaagcccttcatgagactggagaagtacgtgaccctgctgcaggagctggagagacacatggaggacacccaccccgaccaccaggacatcctgaaggccatcgtggccttcaagaccctgatgggccagtgccaggacctgagaaagagaaagcagctggagctgcagatcctgagcgagcccatccaggcctgggagggcgaggacatcaagaacctgggcaacgtgatcttcatgagccaggtgatggtgcagtacggcgcctgcgaggagaaggaggagagatacctgatgctgttcagcaacgtgctgatcatgctgagcgccagccccagaatgagcggcttcatctaccagggcaagatccccatcgccggcaccgtggtgaccagactggacgagatcgagggcaacgactgcaccttcgagatcaccggcaacaccgtggagagaatcgtggtgcactgcaacaacaaccaggacttccaggagtggctggagcagctgaacagactgatcagaggccccgccagctgcagcagcctgagcaagaccagcagcagcagctgcagcgcccacagcagcttcagcagcaccggccagcccagaggccccctggagcccccccagatcatcaagccctggagcctgagctgcctgagacccgccccccccctgagacccagcgccgccctgggctacaaggagagaatgagctacatcctgaaggagagcagcaagagccccaagaccatgaagaagttcctgcacaagagaaagaccgagagaaagcccagcgaggaggagtacgtgatcagaaagagcaccgccgccctggaggaggacgcccagatcctgaaggtgatcgaggcctactgcaccagcgccaacttccagcagggccacggcagcagcaccagaaaggacagcatcccccaggtgctgctgcccgaggaggagaagctgatcatcgaggagaccagaagcaacggccagaccatcatggaggagaagagcctggtggacaccgtgtacgccctgaaggacgaggtgagagagctgaagcaggagaacaagagaatgaagcagtgcctggaggaggagctgaagagcagaagagacctggagaagctggtgagaagactgctgaagcagaccgacgagtgcatcagaggcgagagcagcagcaagaccagcatcctgccctag

SEQ ID NO: 96200 - DNA, 1869 bp, Artificial Sequence
  Description of Artificial Sequence: Synthetic coding sequence
atgaccgagaacggcagccaccagctgatcgtgaaggccagattcaacttcaagcagaccaacgaggacgagctgagcgtgtgcaagggcgacatcatctacgtgaccagagtggaggagggcggctggtgggagggcaccctgaacggcagaaccggctggttccccagcaactacgtgagagagatcaagagcagcgagagacccctgagccccaaggccgtgaagggcttcgagaccgcccccctgaccaagaactactacaccgtggtgctgcagaacatcctggacaccgagaaggagtacgccaaggagctgcagagcctgctggtgacctacctgagacccctgcagagcaacaacaacctgagcaccgtggaggtgaccagcctgctgggcaacttcgaggaggtgtgcaccttccagcagaccctgtgccaggccctggaggagtgcagcaagttccccgagaaccagcacaaggtgggcggctgcctgctgagcctgatgccccacttcaagagcatgtacctggcctactgcgccaaccaccccagcgccgtgaacgtgctgacccagcacagcgacgagctggagcagttcatggagaaccagggcgccagcagccccggcatcctgatcctgaccaccaacctgagcaagcccttcatgagactggagaagtacgtgaccctgctgcaggagctggagagacacatggaggacacccaccccgaccaccaggacatcctgaaggccatcgtggccttcaagaccctgatgggccagtgccaggacctgagaaagagaaagcagctggagctgcagatcctgagcgagcccatccaggcctgggagggcgaggacatcaagaacctgggcaacgtgatcttcatgagccaggtgatggtgcagtacggcgcctgcgaggagaaggaggagagatacctgatgctgttcagcaacgtgctgatcatgctgagcgccagccccagaatgagcggcttcatctaccagggcaagatccccatcgccggcaccgtggtgaccagactggacgagatcgagggcaacgactgcaccttcgagatcaccggcaacaccgtggagagaatcgtggtgcactgcaacaacaaccaggacttccaggagtggctggagcagctgaacagactgatcagaggccccgccagctgcagcagcctgagcaagaccagcagcagcagctgcagcgcccacagcagcttcagcagcaccggccagcccagaggccccctggagcccccccagatcatcaagccctggagcctgagctgcctgagacccgccccccccctgagacccagcgccgccctgggctacaaggagagaatgagctacatcctgaaggagagcagcaagagccccaagaccatgaagaagttcctgcacaagagaaagaccgagagaaagcccagcgaggaggagtacgtgatcagaaagagcaccgccgccctggaggaggacgcccagatcctgaaggtgatcgaggcctactgcaccagcgccaacttccagcagggccacggcagcagcaccagaaaggacagcatcccccaggtgctgctgcccgaggaggagaagctgatcatcgaggagaccagaagcaacggccagaccatcatggaggagaagagcctggtggacaccgtgtacgccctgaaggacgaggtgagagagctgaagcaggagaacaagagaatgaagcagtgcctggaggaggagctgaagagcagaagagacctggagaagctggtgagaagactgctgaagcagaccgacgagtgcatcagaggcgagagcagcagcaagaccagcatcctgccctag

SEQ ID NO: 96201 - DNA, 1869 bp, Artificial Sequence; identical to SEQ ID NO: 96200
  Description of Artificial Sequence: Synthetic coding sequence

SEQ ID NO: 96202 - DNA, 1950 bp, Artificial Sequence
  Description of Artificial Sequence: Synthetic coding sequence
atgaccgagaacggcagccaccagctgatcgtgaaggccagattcaacttcaagcagaccaacgaggacgagctgagcgtgtgcaagggcgacatcatctacgtgaccagagtggaggagggcggctggtgggagggcaccctgaacggcagaaccggctggttccccagcaactacgtgagagagatcaagagcagcgacggcgtgagcctgctgctgcccggcctggagtgcaacggcgccatcagcgcccaccacaacctgtgcctgcccggcagcaagagacccctgagccccaaggccgtgaagggcttcgagaccgcccccctgaccaagaactactacaccgtggtgctgcagaacatcctggacaccgagaaggagtacgccaaggagctgcagagcctgctggtgacctacctgagacccctgcagagcaacaacaacctgagcaccgtggaggtgaccagcctgctgggcaacttcgaggaggtgtgcaccttccagcagaccctgtgccaggccctggaggagtgcagcaagttccccgagaaccagcacaaggtgggcggctgcctgctgagcctgatgccccacttcaagagcatgtacctggcctactgcgccaaccaccccagcgccgtgaacgtgctgacccagcacagcgacgagctggagcagttcatggagaaccagggcgccagcagccccggcatcctgatcctgaccaccaacctgagcaagcccttcatgagactggagaagtacgtgaccctgctgcaggagctggagagacacatggaggacacccaccccgaccaccaggacatcctgaaggccatcgtggccttcaagaccctgatgggccagtgccaggacctgagaaagagaaagcagctggagctgcagatcctgagcgagcccatccaggcctgggagggcgaggacatcaagaacctgggcaacgtgatcttcatgagccaggtgatggtgcagtacggcgcctgcgaggagaaggaggagagatacctgatgctgttcagcaacgtgctgatcatgctgagcgccagccccagaatgagcggcttcatctaccagggcaagatccccatcgccggcaccgtggtgaccagactggacgagatcgagggcaacgactgcaccttcgagatcaccggcaacaccgtggagagaatcgtggtgcactgcaacaacaaccaggacttccaggagtggctggagcagctgaacagactgatcagaggccccgccagctgcagcagcctgagcaagaccagcagcagcagctgcagcgcccacagcagcttcagcagcaccggccagcccagaggccccctggagcccccccagatcatcaagccctggagcctgagctgcctgagacccgccccccccctgagacccagcgccgccctgggctacaaggagagaatgagctacatcctgaaggagagcagcaagagccccaagaccatgaagaagttcctgcacaagagaaagaccgagagaaagcccagcgaggaggagtacgtgatcagaaagagcaccgccgccctggaggaggacgcccagatcctgaaggtgatcgaggcctactgcaccagcgccaacttccagcagggccacggcagcagcaccagaaaggacagcatcccccaggtgctgctgcccgaggaggagaagctgatcatcgaggagaccagaagcaacggccagaccatcatggaggagaagagcctggtggacaccgtgtacgccctgaaggacgaggtgagagagctgaagcaggagaacaagagaatgaagcagtgcctggaggaggagctgaagagcagaagagacctggagaagctggtgagaagactgctgaagcagaccgacgagtgcatcagaggcgagagcagcagcaagaccagcatcctgccctag

SEQ ID NO: 96203 - DNA, 1869 bp, Artificial Sequence
  Description of Artificial Sequence: Synthetic coding sequence
atgaccgagaacggcagccaccagctgatcgtgaaggccagattcaacttcaagcagaccaacgaggacgagctgagcgtgtgcaagggcgacatcatctacgtgaccagagtggaggagggcggctggtgggagggcaccctgaacggcagaaccggctggttccccagcaactacgtgagagagatcaagagcagcgagagacccctgagccccaaggccgtgaagggcttcgagaccgcccccctgaccaagaactactacaccgtggtgctgcagaacatcctggacaccgagaaggagtacgccaaggagctgcagagcctgctggtgacctacctgagacccctgcagagcaacaacaacctgagcaccgtggaggtgaccagcctgctgggcaacttcgaggaggtgtgcaccttccagcagaccctgtgccaggccctggaggagtgcagcaagttccccgagaaccagcacaaggtgggcggctgcctgctgagcctgatgccccacttcaagagcatgtacctggcctactgcgccaaccaccccagcgccgtgaacgtgctgacccagcacagcgacgagctggagcagttcatggagaaccagggcgccagcagccccggcatcctgatcctgaccaccaacctgagcaagcccttcatgagactggagaagtacgtgaccctgctgcaggagctggagagacacatggaggacacccaccccgaccaccaggacatcctgaaggccatcgtggccttcaagaccctgatgggccagtgccaggacctgagaaagagaaagcagctggagctgcagatcctgagcgagcccatccaggcctgggagggcgaggacatcaagaacctgggcaacgtgatcttcatgagccaggtgatggtgcagtacggcgcctgcgaggagaaggaggagagatacctgatgctgttcagcaacgtgctgatcatgctgagcgccagccccagaatgagcggcttcatctaccagggcaagatccccatcgccggcaccgtggtgaccagactggacgagatcgagggcaacgactgcaccttcgagatcaccggcaacaccgtggagagaatcgtggtgcactgcaacaacaaccaggacttccaggagtggctggagcagctgaacagactgatcagaggccccgccagctgcagcagcctgagcaagaccagcagcagcagctgcagcgcccacagcagcttcagcagcaccggccagcccagaggccccctggagcccccccagatcatcaagccctggagcctgagctgcctgagacccgccccccccctgagacccagcgccgccctgggctacaaggaggccttcaccttcgtgttcgaggagagcagcaagagccccaagaccatgaagaagttcctgcacaagagaaagaccgagagaaagcccagcgaggaggagtacgtgatcagaaagagcaccgccgccctggaggaggacgcccagatcctgaaggtgatcgaggcctactgcaccagcgccaacttccagcagggccacggcagcagcaccagaaaggacagcatcccccaggtgctgctgcccgaggaggagaagctgatcatcgaggagaccagaagcaacggccagaccatcatggaggagaagagcctggtggacaccgtgtacgccctgaaggacgaggtgagagagctgaagcaggagaacaagagaatgaagcagtgcctggaggaggagctgaagagcagaagagacctggagaagctggtgagaagactgctgaagcagaccgacgagtgcatcagaggcgagagcagcagcaagaccagcatcctgccctag

SEQ ID NO: 96204 - DNA, 1896 bp, Artificial Sequence
  Description of Artificial Sequence: Synthetic coding sequence
atgttctacgcccacttcgtgctgagcaagagaggccccctggccaagatctggctggccgcccactgggacaagaagctgaccaaggcccacgtgttcgagtgcaacctggagagcagcgtggagagcatcatcagccccaaggtgaagatggccctgagaaccagcggccacctgctgctgggcgtggtgagaatctaccacagaaaggccaagtacctgctggccgactgcaacgaggccttcatcaagatcaagatggccttcagacccggcgtggtggacctgcccgaggagaacagagaggccgcctacaacgccatcaccctgcccgaggagttccacgacttcgaccagcccctgcccgacctggacgacatcgacgtggcccagcagttcagcctgaaccagagcagagtggaggagatcaccatgagagaggaggtgggcaacatcagcatcctgcaggagaacgacttcggcgacttcggcatggacgacagagagatcatgagagagggcagcgccttcgaggacgacgacatgctggtgagcaccaccaccagcaacctgctgctggagagcgagcagagcaccagcaacctgaacgagaagatcaaccacctggagtacgaggaccagtacaaggacgacaacttcggcgagggcaacgacggcggcatcctggacgacaagctgatcagcaacaacgacggcggcatcttcgacgacccccccgccctgagcgaggccggcgtgatgctgcccgagcagcccgcccacgacgacatggacgaggacgacaacgtgagcatgggcggccccgacagccccgacagcgtggaccccgtggagcccatgcccaccatgaccgaccagaccaccctggtgcccaacgaggaggaggccttcgccctggagcccatcgacatcaccgtgaaggagaccaaggccaagagaaagagaaagctgatcgtggacagcgtgaaggagctggacagcaagaccatcagagcccagctgagcgactacagcgacatcgtgaccaccctggacctggccccccccaccaagaagctgatgatgtggaaggagaccggcggcgtggagaagctgttcagcctgcccgcccagcccctgtggaacaacagactgctgaagctgttcaccagatgcctgacccccctggtgcccgaggacctgagaaagagaagaaagggcggcgaggccgacaacctggacgagttcctgaaggagttcgagaaccccgaggtgcccagagaggaccagcagcagcagcaccagcagagagacgtgatcgacgagcccatcatcgaggagcccagcagactgcaggagagcgtgatggaggccagcagaaccaacatcgacgagagcgccatgccccccccccccccccagggcgtgaagagaaaggccggccagatcgaccccgagcccgtgatgcccccccagcaggtggagcagatggagatcccccccgtggagctgccccccgaggagccccccaacatctgccagctgatccccgagctggagctgctgcccgagaaggagaaggagaaggagaaggagaaggaggacgacgaggaggaggaggacgaggacgccagcggcggcgaccaggaccaggaggagagaagatggaacaagagaacccagcagatgctgcacggcctgcagagagccctggccaagaccggcgccgagagcatcagcctgctggagctgtgcagaaacaccaacagaaagcaggccgccgccaagttctacagcttcctggtgctgaagaagcagcaggccatcgagctgacccaggaggagccctacagcgacatcatcgccacccccggccccagattccacatcatctag

SEQ ID NO: 96205 - DNA, 501 bp, Artificial Sequence
  Description of Artificial Sequence: Synthetic coding sequence
atggcccccaagaaggccaagaagagagccggcggcgccaacagcaacgtgttcagcatgttcgagcagacccagatccaggagttcaaggaggccttcaccatcatggaccagaacagagacggcttcatcgacaagaacgacctgagagacaccttcgccgccctgggcagagtgaacgtgaagaacgaggagatcgacgagatgatcaaggaggcccccggccccatcaacttcaccgtgttcctgaccatgttcggcgagaagctgaagggcgccgaccccgaggagaccatcctgaacgccttcaaggtgttcgaccccgagggcaagggcgtgctgaaggccgactacgtgagagagatgctgaccacccaggccgagagattcagcaaggaggaggtggaccagatgttcgccgccttcccccccgacgtgaccggcaacctggactacaagaacctggtgcacatcatcacccacggcgaggagaaggactag

SEQ ID NO: 96206 - DNA, 909 bp, Artificial Sequence
  Description of Artificial Sequence: Synthetic coding sequence
atggtgagacccgtgagacacaagaagcccgtgaactacagccagttcgaccacagcgacagcgacgacgacttcgtgagcgccaccgtgcccctgaacaagaagagcagaaccgcccccaaggagctgaagcaggacaagcccaagcccaacctgaacaacctgagaaaggaggagatccccgtgcaggagaagacccccaagaagagactgcccgagggcaccttcagcatccccgccagcgccgtgccctgcaccaagatggccctggacgacaagctgtaccagagagacctggaggtggccctggccctgagcgtgaaggagctgcccaccgtgaccaccaacgtgcagaacagccaggacaagagcatcgagaagcacggcagcagcaagatcgagaccatgaacaagagcccccacatcagcaactgcagcgtggccagcgactacctggacctggacaagatcaccgtggaggacgacgtgggcggcgtgcagggcaagagaaaggccgccagcaaggccgccgcccagcagagaaagatcctgctggagggcagcgacggcgacagcgccaacgacaccgagcccgacttcgcccccggcgaggacagcgaggacgacagcgacttctgcgagagcgaggacaacgacgaggacttcagcatgagaaagagcaaggtgaaggagatcaagaagaaggaggtgaaggtgaagagccccgtggagaagaaggagaagaagagcaagagcaagtgcaacgccctggccgccagcggcggcagcagaagcagcagcagccccctggtggtggtgagcgtgaagagccccaaccagagcctgagactgggcctgagcagactggccagagtgaagcccctgcaccccaacgccaccagcacctag

SEQ ID NO: 96207 - DNA, 1008 bp, Artificial Sequence
  Description of Artificial Sequence: Synthetic coding sequence
atggtgagacccgtgagacacaagaagcccgtgaactacagccagttcgaccacagcgacagcgacgacgacttcgtgagcgccaccgtgcccctgaacaagaagagcagaaccgcccccaaggagctgaagcaggacaagcccaagcccaacctgaacaacctgagaaaggaggagatccccgtgcaggagaagacccccaagaagagaatggccctggacgacaagctgtaccagagagacctggaggtggccctggccctgagcgtgaaggagctgcccaccgtgaccaccaacgtgcagaacagccaggacaagagcatcgagaagcacggcagcagcaagatcgagaccatgaacaagagcccccacatcagcaactgcagcgtggccagcgactacctggacctggacaagatcaccgtggaggacgacgtgggcggcgtgcagggcaagagaaaggccgccagcaaggccgccgcccagcagagaaagatcctgctggagggcagcgacggcgacagcgccaacgacaccgagcccgacttcgcccccggcgaggacagcgaggacgacagcgacttctgcgagagcgaggacaacgacgaggacttcagcatgagaaagagcaaggtgaaggagatcaagaagaaggaggtgaaggtgaagagccccgtggagaagaaggagaagaagagcaagagcaagtgcaacgccctggtgaccagcgtggacagcgcccccgccgccgtgaagagcgagagccagagcctgcccaagaaggtgagcctgagcagcgacaccaccagaaagcccctggagatcagaagccccagcgccgagagcaagaagcccaagtgggtgccccccgccgccagcggcggcagcagaagcagcagcagccccctggtggtggtgagcgtgaagagccccaaccagagcctgagactgggcctgagcagactggccagagtgaagcccctgcaccccaacgccaccagcacctag

SEQ ID NO: 96208 - DNA, 702 bp, Artificial Sequence
  Description of Artificial Sequence: Synthetic coding sequence
atgaacaagagcccccacatcagcaactgcagcgtggccagcgactacctggacctggacaagatcaccgtggaggacgacgtgggcggcgtgcagggcaagagaaaggccgccagcaaggccgccgcccagcagagaaagatcctgctggagggcagcgacggcgacagcgccaacgacaccgagcccgacttcgcccccggcgaggacagcgaggacgacagcgacttctgcgagagcgaggacaacgacgaggacttcagcatgagaaagagcaaggtgaaggagatcaagaagaaggaggtgaaggtgaagagccccgtggagaagaaggagaagaagagcaagagcaagtgcaacgccctggtgaccagcgtggacagcgcccccgccgccgtgaagagcgagagccagagcctgcccaagaaggtgagcctgagcagcgacaccaccagaaagcccctggagatcagaagccccagcgccgagagcaagaagcccaagtgggtgccccccggcatggcctacctgagcagcagaaccggcgcctggaagatcatcaccgccgccagcggcggcagcagaagcagcagcagccccctggtggtggtgagcgtgaagagccccaaccagagcctgagactgggcctgagcagactggccagagtgaagcccctgcaccccaacgccaccagcacctag

SEQ ID NO: 96209 - DNA, 408 bp, Artificial Sequence
  Description of Artificial Sequence: Synthetic coding sequence
atgagaggcaagaccttcagattcgagatgcagagagacctggtgagcttccccctgagccccgccgtgagagtgaagctggtgagcgccggcttccagaccgccgaggagctgctggaggtgaagcccagcgagctgagcaaggaggtgggcatcagcaaggccgaggccctggagaccctgcagatcatcagaagagagtgcctgaccaacaagcccagatacgccggcaccagcgagagccacaagaagtgcaccgccctggagctgctggagcaggagcacacccagggcttcatcatcaccttctgcagcgccctggacgacatcctgggcggcggcgtgcccctgatgaagaccaccgagatctgcggcgcccccggcgtgggcaagacccagctgtggtag

SEQ ID NO: 96210 - DNA, 855 bp, Artificial Sequence
  Description of Artificial Sequence: Synthetic coding sequence
atggccgagctggtgcccttcgccgtgcccatcgagagcgacaagaccctgctggtgtgggagctgagcagcggccccaccgccgaggccctgcaccacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggagggccccctgagcttcctgatgaagagaaagaccgcccagaagctggccatccagaaggccctgagcgacgccttccagaagctgctgatcgtggtgctggagagcggcaagatcgccgtggagtacagacccagcgaggacatcgtgggcgtgagatgcgaggaggagctgcacggcctgatccaggtgccctgcagcccctggaagcagtacggccaggaggaggagggctacctgagcgacttcagcctggaggaggaggagttcagactgcccgagctggactag

SEQ ID NO: 96211 - DNA, 351 bp, Artificial Sequence
  Description of Artificial Sequence: Synthetic coding sequence
atgcacctgctggtgccccccccccagcacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaaggaccactaccacagcctgtag

SEQ ID NO: 96212 - DNA, 711 bp, Artificial Sequence
  Description of Artificial Sequence: Synthetic coding sequence
atggccgagctggtgcccttcgccgtgcccatcgagagcgacaagaccctgctggtgtgggagctgagcagcggccccaccgccgaggccctgcaccacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggagggccccctgagcttcctgatgaagagaaagaccgcccagaagctggccatccagaaggccctgagcgacgccttccagaagctgctgatcgtggtgctgggcaagaccgtgctgatcatcctggaggtgctgcagttccagtag

SEQ ID NO: 96213 - DNA, 786 bp, Artificial Sequence
  Description of Artificial Sequence: Synthetic coding sequence
atgcacctgctggtgccccccccccagcacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggagggccccctgagcttcctgatgaagagaaagaccgcccagaagctggccatccagaaggccctgagcgacgccttccagaagctgctgatcgtggtgctggagagcggcaagatcgccgtggagtacagacccagcgaggacatcgtgggcgtgagatgcgaggaggagctgcacggcctgatccaggtgccctgcagcccctggaagcagtacggccaggaggaggagggctacctgagcgacttcagcctggaggaggaggagttcagactgcccgagctggactag

SEQ ID NO: 96214 - DNA, 393 bp, Artificial Sequence
  Description of Artificial Sequence: Synthetic coding sequence
ttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggaggagagcggcaagatcgccgtggagtacagacccagcgaggacatcgtgggcgtgagatgcgaggaggagctgcacggcctgatccaggtgccctgcagcccctggaagcagtacggccaggaggaggagggctacctgagcgacttcagcctggaggaggaggagttcagactgcccgagctggactag

SEQ ID NO: 96215 - DNA, 501 bp, Artificial Sequence
  Description of Artificial Sequence: Synthetic coding sequence
atggccgagctggtgcccttcgccgtgcccatcgagagcgacaagaccctgctggtgtgggagctgagcagcggccccaccgccgaggccctgcaccacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaaggtgccctgcagcccctggaagcagtacggccaggaggaggagggctacctgagcgacttcagcctggaggaggaggagttcagactgcccgagctggactag

SEQ ID NO: 96216 - DNA, 642 bp, Artificial Sequence
  Description of Artificial Sequence: Synthetic coding sequence
atgcacctgctggtgccccccccccagcacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggagggccccctgagcttcctgatgaagagaaagaccgcccagaagctggccatccagaaggccctgagcgacgccttccagaagctgctgatcgtggtgctgggcaagaccgtgctgatcatcctggaggtgctgcagttccagtag

SEQ ID NO: 96217 - DNA, 756 bp, Artificial Sequence
  Description of Artificial Sequence: Synthetic coding sequence
atggccgagctggtgcccttcgccgtgcccatcgagagcgacaagaccctgctggtgtgggagctgagcagcggccccaccgccgaggccctgcaccacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaagctgcaggagctgagcgacctggaggagagagagaacgaggacagcatggtgcccctgcccaagcagagcctgaagttcttctgcgccctggaggtggtgctgcccagctgcgactgcagaagccccggcatcggcctggtggaggagcccatggacaaggtggaggaggagagcggcaagatcgccgtggagtacagacccagcgaggacatcgtgggcgtgagatgcgaggaggagctgcacggcctgatccaggtgccctgcagcccctggaagcagtacggccaggaggaggagggctacctgagcgacttcagcctggaggaggaggagttcagactgcccgagctggactag

SEQ ID NO: 96218 - DNA, 420 bp, Artificial Sequence
  Description of Artificial Sequence: Synthetic coding sequence
atggccgagctggtgcccttcgccgtgcccatcgagagcgacaagaccctgctggtgtgggagctgagcagcggccccaccgccgaggccctgcaccacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaaggaccactaccacagcctgtag

SEQ ID NO: 96219 - DNA, 432 bp, Artificial Sequence
  Description of Artificial Sequence: Synthetic coding sequence
atgcacctgctggtgccccccccccagcacagcctgttcaccgccttcagccagttcggcctgctgtacagcgtgagagtgttccccaacgccgccgtggcccaccccggcttctacgccgtgatcaagttctacagcgccagagccgcccacagagcccagaaggcctgcgacagaaagcagctgttccagaagagccccgtgaaggtgagactgggcaccagacacaaggccgtgcagcaccaggccctggccctgaacagcagcaagtgccaggagctggccaactactacttcggcttcaacggctgcagcaagagaatcatcaaggtgccctgcagcccctggaagcagtacggccaggaggaggagggctacctgagcgacttcagcctggaggaggaggagttcagactgcccgagctggactag

SEQ ID NO: 96220 - DNA, 2733 bp, Artificial Sequence
  Description of Artificial Sequence: Synthetic coding sequence
atgagaagaagcgccgcccccagccagctgcagggcaacagcttcaagaagcccaagttcatcccccccggcagaagcaaccccggcctgaacgaggagatcaccaagctgaaccccgacatcaagctgttcgagggcgtggccatcaacaacaccttcctgcccagccagaacgacctgagaatctgcagcctgaacctgcccagcgaggagagcaccagagagatcaacaacagagacaactgcagcggcaagtactgcttcgaggcccccaccctggccaccctggaccccccccacaccgtgcacagcgcccccaaggaggtggccgtgagcaaggagcaggaggagaagagcgacagcctggtgaagtacttcagcgtggtgtggtgcaagcccagcaagaagaagcacaagaagtgggagggcgacgccgtgctgatcgtgaagggcaagagcttcatcctgaagaacctggagggcaaggacatcggcagaggcatcggctacaagttcaaggagctggagaagatcgaggagggccagaccctgatgatctgcggcaaggagatcgaggtgatgggcgtgatcagccccgacgacttcagcagcggcagatgcttccagctgggcggcggcagcaccgccatcagccacagcagccaggtggccagaaagtgcttcagcaaccccttcaagagcgtgtgcaagcccagcagcaaggagaacagacagaacgacttccagaactgcaagcccagacacgacccctacacccccaacagcctggtgatgcccagacccgacaagaaccaccagtgggtgttcaacaagaactgcttccccctggtggacgtggtgatcgacccctacctggtgtaccacctgagaccccaccagaaggagggcatcatcttcctgtacgagtgcgtgatgggcatgagaatgaacggcagatgcggcgccatcctggccgacgagatgggcctgggcaagaccctgcagtgcatcagcctgatctggaccctgcagtgccagggcccctacggcggcaagcccgtgatcaagaagaccctgatcgtgacccccggcagcctggtgaacaactggaagaaggagttccagaagtggctgggcagcgagagaatcaagatcttcaccgtggaccaggaccacaaggtggaggagttcatcaagagcatcttctacagcgtgctgatcatcagctacgagatgctgctgagaagcctggaccagatcaagaacatcaagttcgacctgctgatctgcgacgagggccacagactgaagaacagcgccatcaagaccaccaccgccctgatcagcctgagctgcgagaagagaatcatcctgaccggcacccccatccagaacgacctgcaggagttcttcgccctgatcgacttcgtgaaccccggcatcctgggcagcctgagcagctacagaaagatctacgaggagcccatcatcctgagcagagagcccagcgccagcgaggaggagaaggagctgggcgagagaagagccgccgagctgacctgcctgaccggcctgttcatcctgagaagaacccaggagatcatcaacaagtacctgccccccaagatcgagaacgtggtgttctgcagacccggcgccctgcagatcgagctgtacagaaagctgctgaacagccaggtggtgagattctgcctgcagggcctgctggagaacagcccccacctgatctgcatcggcgccctgaagaagctgtgcaaccacccctgcctgctgttcaacagcatcaaggagaaggagtgcagcagcacctgcgacaagaacgaggagaagagcctgtacaagggcctgctgagcgtgttccccgccgactacaaccccctgctgttcaccgagaaggagagcggcaagctgcaggtgctgagcaagctgctggccgtgatccacgagctgagacccaccgagaaggtggtgctggtgagcaactacacccagaccctgaacatcctgcaggaggtgtgcaagagacacggctacgcctacaccagactggacggccagacccccatcagccagagacagcagatcgtggacggcttcaacagccagcacagcagcttcttcatcttcctgctgagcagcaaggccggcggcgtgggcctgaacctgatcggcggcagccacctgatcctgtacgacatcgactggaaccccgccaccgacatccaggccatgagcagagtgtggagagacggccagaagtaccccgtgcacatctacagactgctgaccaccggcaccatcgaggagaagatctaccagagacagatcagcaagcagggcctgtgcggcgccgtggtggacctgaccaagaccagcgagcacatccagttcagcgtggaggagctgaagaacctgttcaccctgcacgagagcagcgactgcgtgacccacgacctgctggactgcgagtgcaccggcgaggaggtgcacaccggcgacagcctggagaagttcatcgtgagcagagactgccagctgggcccccaccaccagaagagcaacagcctgaagcccctgagcatgagccagctgaagcagtggaagcacttcagcggcgaccacctgaacctgaccgaccccttcctggagagaatcaccgagaacgtgagcttcatcttccagaacatcaccacccaggccaccggcacctag

SEQ ID NO: 96221 - DNA, 900 bp, Artificial Sequence
  Description of Artificial Sequence: Synthetic coding sequence
atggtgggcaaggccagaagcagcaacttcaccctgagcgagaagctggacctgctgaagctggtgaagccctacgtgaagatcctggaggagcacaccaacaagcacagcgtgatcgtggagaagaacagatgctgggacatcatcgccgtgaactacaacgccatcggcgtggacagaccccccagaaccgcccagggcctgagaaccctgtacaagagactgaaggagtacgccaagcaggagctgctgcagcagaaggagacccagagcgacttcaagagcaacatcagcgagcccaccaagaaggtgatggagatgatcccccagatcagcagcttctgcctggtgagagacagaaaccacatccagagcgccaacctggacgaggaggcccaggccggcaccagcagcctgcaggtgatgctggaccaccaccccgtggccatcaccgtggaggtgaagcaggaggaggacatcaagccccccccccccctggtgctgaacagccagcagagcgacaccctggagcagagagaggagcacgagctggtgcacgtgatggagagaagcctgagccccagcctgagcagcgtggacatgagaatgaccagcagccccagcagcatccccagaagagacgacttcttcagacacgagagcggcgagcacttcagaagcctgctgggctacgacccccagatcctgcagatgctgaaggaggagcaccagatcatcctggagaaccagaagaacttcggcctgtacgtgcaggagaagagagacggcctgaagagaagacagcagctggaggaggagctgctgagagccaagatcgaggtggagaagctgaaggccatcagactgagacacgacctgcccgagtacaacagcctgtag

SEQ ID NO: 96222 - DNA, 378 bp, Artificial Sequence
  Description of Artificial Sequence: Synthetic coding sequence
atgagaagaagcgccgcccccagccagctgcagggcaacagcttcaagaagcccaagttcatcccccccggcagaagcaaccccggcctgaacgaggagatcaccaagctgaaccccgacatcaagctgttcgagggcgtggccatcaacaacaccttcctgcccagccagaacgacctgagaatctgcagcctgaacctgcccagcgaggagagcaccagagagatcaacaacagagacaactgcagcggcaagtactgcttcgaggcccccaccctggccaccctggaccccccccacaccgtgcacagcgcccccaaggaggtggccgtgagcaaggagcaggaggagaagagcgacagcctggtgaagtactag

SEQ ID NO: 96223 - DNA, 354 bp, Artificial Sequence
  Description of Artificial Sequence: Synthetic coding sequence
atgagaagaagcgccgcccccagccagctgcagggcaacagcttcaagaagcccaagttcatcccccccggcagaagcaaccccggcctgaacgaggagatcaccaagctgaaccccgacatcaagctgttcgagggcgtggccatcaacaacaccttcctgcccagccagaacgacctgagaatctgcagcctgaacctgcccagcgaggagagcaccagagagatcaacaacagagacaactgcagcggcaagtactgcttcgaggcccccaccctggccaccctggaccccccccacaccgtgcagacctggatgagaagacacagactggtgcccgtgcactacagatag

SEQ ID NO: 96224 - DNA, 477 bp, Artificial Sequence
  Description of Artificial Sequence: Synthetic coding sequence
atgctggaccaccaccccgtggccatcaccgtggaggtgaagcaggaggaggacatcaagccccccccccccctggtgctgaacagccagcagagcgacaccctggagcagagagaggagcacgagctggtgcacgtgatggagagaagcctgagccccagcctgagcagcgtggacatgagaatgaccagcagccccagcagcatccccagaagagacgacttcttcagacacgagagcggcgagcacttcagaagcctgctgggctacgacccccagatcctgcagatgctgaaggaggagcaccagatcatcctggagaaccagaagaacttcggcctgtacgtgcaggagaagagagacggcctgaagagaagacagcagctggaggaggagctgctgagagccaagatcgaggtggagaagctgaaggccatcagactgagacacgacctgcccgagtacaacagcctgtag

SEQ ID NO: 96225 - DNA, 1749 bp, Artificial Sequence
  Description of Artificial Sequence: Synthetic coding sequence
atgggcctgggcaagaccctgcagtgcatcagcctgatctggaccctgcagtgccagggcccctacggcggcaagcccgtgatcaagaagaccctgatcgtgacccccggcagcctggtgaacaactggaagaaggagttccagaagtggctgggcagcgagagaatcaagatcttcaccgtggaccaggaccacaaggtggaggagttcatcaagagcatcttctacagcgtgctgatcatcagctacgagatgctgctgagaagcctggaccagatcaagaacatcaagttcgacctgctgatctgcgacgagggccacagactgaagaacagcgccatcaagaccaccaccgccctgatcagcctgagctgcgagaagagaatcatcctgaccggcacccccatccagaacgacctgcaggagttcttcgccctgatcgacttcgtgaaccccggcatcctgggcagcctgagcagctacagaaagatctacgaggagcccatcatcctgagcagagagcccagcgccagcgaggaggagaaggagctgggcgagagagagcagctgaacctgctggccagcctggacagcctgctgagaagaacccaggagatcatcaacaagtacctgccccccaagatcgagaacgtggtgttctgcagacccggcgccctgcagatcgagctgtacagaaagctgctgaacagccaggtggtgagattctgcctgcagggcctgctggagaacagcccccacctgatctgcatcggcgccctgaagaagctgtgcaaccacccctgcctgctgttcaacagcatcaaggagaaggagtgcagcagcacctgcgacaagaacgaggagaagagcctgtacaagggcctgctgagcgtgttccccgccgactacaaccccctgctgttcaccgagaaggagagcggcaagctgcaggtgctgagcaagctgctggccgtgatccacgagctgagacccaccgagaaggtggtgctggtgagcaactacacccagaccctgaacatcctgcaggaggtgtgcaagagacacggctacgcctacaccagactggacggccagacccccatcagccagagacagcagatcgtggacggcttcaacagccagcacagcagcttcttcatcttcctgctgagcagcaaggccggcggcgtgggcctgaacctgatcggcggcagccacctgatcctgtacgacatcgactggaaccccgccaccgacatccaggccatgagcagagtgtggagagacggccagaagtaccccgtgcacatctacagactgctgaccaccggcaccatcgaggagaagatctaccagagacagatcagcaagcagggcctgtgcggcgccgtggtggacctgaccaagaccagcgagcacatccagttcagcgtggaggagctgaagaacctgttcaccctgcacgagagcagcgactgcgtgacccacgacctgctggactgcgagtgcaccggcgaggaggtgcacaccggcgacagcctggagaagttcatcgtgagcagagactgccagctgggcccccaccaccagaagagcaacagcctgaagcccctgagcatgagccagctgaagcagtggaagcacttcagcggcgaccacctgaacctgaccgaccccttcctggagagaatcaccgagaacgtgagcttcatcttccagaacatcaccacccaggccaccggcacctag

SEQ ID NO: 96226 - DNA, 1290 bp, Artificial Sequence
  Description of Artificial Sequence: Synthetic coding sequence
atggccgccatgctgaagtgcgtgatgagcggcagccaggtgaaggtgttcggcaaggccgtgcaggccctgagcagaatcagcgacgagttctggctggaccccagcaagaagggcctggccctgagatgcgtgaacagcagcagaagcgcctacggctgcgtgctgttcagccccgtgttcttccagcactaccagtggagcgccctggtgaagatgagcgagaacgagctggacaccaccctgcacctgaagtgcaagctgggcatgaagagcatcctgcccatcttcagatgcctgaacagcctggagagaaacatcgagaagtgcagaatcttcaccagaagcgacaagtgcaaggtggtgatccagttcttctacagacacggcatcaagagaacccacaacatctgcttccaggagagccagcccctgcaggtgatcttcgacaagaacgtgtgcaccaacaccctgatgatccagcccagactgctggccgacgccatcgtgctgttcaccagcagccaggaggaggtgaccctggccgtgacccccctgaacttctgcctgaagagcagcaacgaggagagcatggacctgagcaacgccgtgcacagcgagatgttcgtgggcagcgacgagttcgacttcttccagatcggcatggacaccgagatcaccttctgcttcaaggagctgaagggcatcctgaccttcagcgaggccacccacgcccccatcagcatctacttcgacttccccggcaagcccctggccctgagcatcgacgacatgctggtggaggccaacttcatcctggccaccctggccgacgagcagagcagagccagcagcccccagagcctgtgcctgagccagaagagaaagagaagcgacctgatcgagaagaaggccggcaagaacgtgaccggccaggccctggagtgcatcagcaagaaggccgcccccagaagactgtaccccaaggagaccctgaccaacatcagcgccctggagaactgcggcagccccgccatgaagagagtggacggcgacgtgagcgaggtgagcgagagcagcgtgagcaacaccgaggaggtgcccggcagcctgtgcctgagaaagttcagctgcatgttcttcggcgccgtgagcagcgaccagcaggagcacttcaaccaccccttcgacagcctggccagagccagcgacagcgaggaggacatgaacaacgtgtgctgcagaaaggagttcaacggcagcgacgccaagtacttctgcatcatctag

SEQ ID NO: 96227 - DNA, 1038 bp, Artificial Sequence
  Description of Artificial Sequence: Synthetic coding sequence
atgagcgagaacgagctggacaccaccctgcacctgaagtgcaagctgggcatgaagagcatcctgcccatcttcagatgcctgaacagcctggagagaaacatcgagaagtgcagaatcttcaccagaagcgacaagtgcaaggtggtgatccagttcttctacagacacggcatcaagagaacccacaacatctgcttccaggagagccagcccctgcaggtgatcttcgacaagaacgtgtgcaccaacaccctgatgatccagcccagactgctggccgacgccatcgtgctgttcaccagcagccaggaggaggtgaccctggccgtgacccccctgaacttctgcctgaagagcagcaacgaggagagcatggacctgagcaacgccgtgcacagcgagatgttcgtgggcagcgacgagttcgacttcttccagatcggcatggacaccgagatcaccttctgcttcaaggagctgaagggcatcctgaccttcagcgaggccacccacgcccccatcagcatctacttcgacttccccggcaagcccctggccctgagcatcgacgacatgctggtggaggccaacttcatcctggccaccctggccgacgagcagagcagagccagcagcccccagagcctgtgcctgagccagaagagaaagagaagcgacctgatcgagaagaaggccggcaagaacgtgaccggccaggccctggagtgcatcagcaagaaggccgcccccagaagactgtaccccaaggagaccctgaccaacatcagcgccctggagaactgcggcagccccgccatgaagagagtggacggcgacgtgagcgaggtgagcgagagcagcgtgagcaacaccgaggaggtgcccggcagcctgtgcctgagaaagttcagctgcatgttcttcggcgccgtgagcagcgaccagcaggagcacttcaaccaccccttcgacagcctggccagagccagcgacagcgaggaggacatgaacaacggcagcttcagcatcttctag

SEQ ID NO: 96228 - DNA, 1038 bp, Artificial Sequence; identical to SEQ ID NO: 96227
  Description of Artificial Sequence: Synthetic coding sequence

SEQ ID NO: 96229 - DNA, 1449 bp, Artificial Sequence; identical to SEQ ID NO: 82211
  Description of Artificial Sequence: Synthetic coding sequence

SEQ ID NO: 96230 - DNA, 1410 bp, Artificial Sequence
  Description of Artificial Sequence: Synthetic coding sequence
atggaggacagcaccagccccaagcaggagaaggagaaccaggaggagctgggcgagaccagaagaccctgggagggcaagaccgccgccagcccccagtacagcgagcccgagagcagcgagcccctggaggccaagcagggccccgagaccggcagacagagcagaagcagcagaccctggagcccccagagcagagccaagacccccctgggcggccccgccggccccgagaccagcagccccgcccccgtgagccccagagagcccagcagcagccccagccccctggcccccgccagacaggacctggccgcccccccccagagcgacagaaccaccagcgtgatccccgaggccggcaccccctaccccgaccccctggagcagagcagcgacaagagagagagcaccccccaccacaccagccagagcgagggcaacaccttccagcagagccagcagcccaagccccacctgtgcggcagaagagacgtgagctacaacaacgccaagcagaaggagctgagattcgacgtgttccaggaggaggacagcaacagcgactacgacctgcagcagcccgcccccggcggcagcgaggtggcccccagcatgctggagatcaccatccagaacgccaaggcctacctgctgaagaccagcagcaacagcggcttcaacctgtacgaccacctgagcaacatgctgaccaagatcctgaacgagagacccgagaacgccgtggacatcttcgagaacatcagccaggacgtgaagatggcccacttcagcaagaagttcgacgccctgcagaacgagaacgagctgctgcccacctacgagatcgccgagaagcagaaggccctgttcctgcagggccacctggagggcgtggaccaggagctggaggacgagatcggcagatgcaactggttcaacagcatccagaagaacgaggaggaggaggaggaggaggacgaggagaaggacgacagcgactacatcgagcaggaggtgggcctgcccctgctgacccccatcagcgaggacctggagatccagaacatccccccctggaccaccagactgagcagcaacctgatcccccagtacgccatcgccgtgctgcagagcaacctgtggcccggcgcctacgccttcagcaacggcaagaagttcgagaacttctacatcggctggggccacaagtacagccccgacaactacaccccccccgtgcccccccccgtgtaccaggagtaccccagcggccccgagatcaccgagatggacgaccccagcgtggaggaggagcaggccttcagagccgcccaggaggccgtgctgctggccgccgagaacgaggagagcgaggaggacgaggacgaggaggacgactacgactag

SEQ ID NO: 96231 - DNA, 1803 bp, Artificial Sequence
  Description of Artificial Sequence: Synthetic coding sequence
atggaggacagcaccagccccaagcaggagaaggagaaccaggaggagctgggcgagaccagaagaccctgggagggcaagaccgccgccagcccccagtacagcgagcccgagagcagcgagcccctggaggccaagcagggccccgagaccggcagacagagcagaagcagcagaccctggagcccccagagcagagccaagacccccctgggcggccccgccggccccgagaccagcagccccgcccccgtgagccccagagagcccagcagcagccccagccccctggcccccgccagacaggacctggccgcccccccccagagcgacagaaccaccagcgtgatccccgaggccggcaccccctaccccgaccccctggagcagagcagcgacaagagagagagcaccccccaccacaccagccagagcgagggcaacaccttccagcagagccagcagcccaagccccacctgtgcggcagaagagacgtgagctacaacaacgccaagcagaaggagctgagattcgacgtgttccaggaggaggacagcaacagcgactacgacctgcagcagcccgcccccggcggcagcgaggtggcccccagcatgctggagatcaccatccagaacgccaaggcctacctgctgaagaccagcagcaacagcggcttcaacctgtacgaccacctgagcaacatgctgaccaagatcctgaacgagagacccgagaacgccgtggacatcttcgagaacatcagccaggacgtgaagatggcccacttcagcaagaagttcgacgccctgcagaacgagaacgagctgctgcccacctacgagatcgccgagaagcagaaggccctgttcctgcagggccacctggagggcgtggaccaggagctggaggacgagatcgccgagaacgccctgcccaacgtgatggagagcgccttctacttcgagcaggccggcgtgggcctgggcaccgacgagacctacagaatcttcctggccctgaagcagctgaccgacacccaccccatccagagatgcagattctggggcaagatcctgggcctggagatgaactacatcgtggccgaggtggagttcagagagggcgaggacgaggaggaggtggaggaggaggacgtggccgaggagagagacaacggcgagagcgaggcccacgaggacgaggaggacgagctgcccaagagcttctacaaggccccccaggccatccccaaggaggagagcagaaccggcgccaacaagtacgtgtacttcgtgtgcaacgagcccggcagaccctgggtgaagctgccccccgtgatccccgcccagatcgtgatcgccagaaagatcaagaagttcttcaccggcagactggacgcccccatcatcagctacccccccttccccggcaacgagagcaactacctgagagcccagatcgccagaatcagcgccggcacccacgtgagccccctgggcttctaccagttcggcgaggaggagggcgaggaggaggaggaggccgagggcggcagaaacagcttcgaggagaaccccgacttcgagggcatccaggtgatcgacctggtggagagcctgagcaactgggtgcaccacgtgcagcacatcctgagccagagattcagaatctacccccccggccagcacggctacccccagatcagcttccacaacatgctgctgcagagcttcaaccccaccttcggcctggagcacatgcccagccccatggccaagagcctgaagatcagcacctag

SEQ ID NO: 96232 - DNA, 1536 bp, Artificial Sequence
  Description of Artificial Sequence: Synthetic coding sequence
atgctggagatcaccatccagaacgccaaggcctacctgctgaagaccagcagcaacagcggcttcaacctgtacgaccacctgagcaacatgctgaccaagatcctgaacgagagacccgagaacgccgtggacatcttcgagaacatcagccaggacgtgaagatggcccacttcagcaagaagttcgacgccctgcagaacgagaacgagctgctgcccacctacgagatcgccgagaagcagaaggccctgttcctgcagggccacctggagggcgtggaccaggagctggaggacgagatcgccgagaacgccctgcccaacgtgatggagagcgccttctacttcgagcaggccggcgtgggcctgggcaccgacgagacctacagaatcttcctggccctgaagcagctgaccgacacccaccccatccagagatgcagattctggggcaagatcctgggcctggagatgaactacatcgtggccgaggtggagttcagagagggcgaggacgaggaggaggtggaggaggaggacgtggccgaggagagagacaacggcgagagcgaggcccacgaggacgaggaggacgagctgcccaagagcttctacaaggccccccaggccatccccaaggaggagagcagaaccggcgccaacaagtacgtgtacttcgtgtgcaacgagcccggcagaccctgggtgaagctgccccccgtgatccccgcccagatcgtgatcgccagaaagatcaagaagttcttcaccggcagactggacgcccccatcatcagctacccccccttccccggcaacgagagcaactacctgagagcccagatcgccagaatcagcgccggcacccacgtgagccccctgggcttctaccagttcggcgaggaggagggcgaggaggaggaggaggccgagggcggcagaaacagcttcgaggagaaccccgacttcgagggcatccaggtgatcgacctggtggagagcctgagcaactgggtgcaccacgtgcagcacatcctgagccagggcagatgcaactggttcaacagcatccagaagaacgaggaggaggaggaggaggaggacgaggagaaggacgacagcgactacatcgagcaggaggtgggcctgcccctgctgacccccatcagcgaggacctggagatccagaacatccccccctggaccaccagactgagcagcaacctgatcccccagtacgccatcgccgtgctgcagagcaacctgtggcccggcgcctacgccttcagcaacggcaagaagttcgagaacttctacatcggctggggccacaagtacagccccgacaactacaccccccccgtgcccccccccgtgtaccaggagtaccccagcggccccgagatcaccgagatggacgaccccagcgtggaggaggagcaggccttcagagccgcccaggaggccgtgctgctggccgccgagaacgaggagagcgaggaggacgaggacgaggaggacgactacgactag

SEQ ID NO: 96233 - DNA, 531 bp, Artificial Sequence
  Description of Artificial Sequence: Synthetic coding sequence
atgctggtgaagagagactacagatacgacagagtgctgttctggggcagaatcctgggcctggtggccgactactacatcgcccagggcctgagcgaggaccagctggcccccagaaagaccctgtacagcctgaactgcaccgagtggagcctgctgccccccgccaccgaggagatggtggcccagagcagcgtggtgaagggcagattcatgggcgaccccagctacgagtacgagcacaccgagctgcagaaggtgaacgagggcgagaaggtgttcgaggaggagatcgtggtgcagatcaaggaggagaccagactggtgagcgtgatcgaccagatcgacaaggccgtggccatcatccccagaggcgccctgttcaagacccccttcggccccacccacgtgaacagaaccttcgagggctactacaactggtacaagacccccgccccccaccccacctgcgacggcaaccagggcgtgagagccagaggcagaagccccagcctgggcagattcctgtag

SEQ ID NO: 96234 - DNA, 831 bp, Artificial Sequence
  Description of Artificial Sequence: Synthetic coding sequence
atggacgccgacagcctgctgctgagcctggagctggccagcggcagcggccagggcctgagccccgacagaagagccagcctgctgaccagcctgatgctggtgaagagagactacagatacgacagagtgctgttctggggcagaatcctgggcctggtggccgactactacatcgcccagggcctgagcgaggaccagctggcccccagaaagaccctgtacagcctgaactgcaccgagtggagcctgctgccccccgccaccgaggagatggtggcccagagcagcgtggtgaagggcagattcatgggcgaccccagctacgagtacgagcacaccgagctgcagaaggtgaacgagggcgagaaggtgttcgaggaggagatcgtggtgcagatcaaggaggagaccagactggtgagcgtgatcgaccagatcgacaaggccgtggccatcatccccagaggcgccctgttcaagacccccttcggccccacccacgtgaacagaaccttcgagggcctgagcctgagcgaggccaagaagctgagcagctacttccacttcagagagcccgtggagctgaagaacaagaccctgctggagaaggccgacctggaccccagcctggacttcatggacagcctggagcacgacatccccaagggcagctggagcatccagatggagagaggcaacgccctggtggtgctgagaagcctgctgtggcccggcctgaccttctaccacgcccccagaaccaagaactacggctacgtgtacgtgggcaccggcgagaagaacatggacctgcccttcatgctgtag

SEQ ID NO: 96235 - DNA, 921 bp, Artificial Sequence
  Description of Artificial Sequence: Synthetic coding sequence
atggacgccgacagcctgctgctgagcctggagctggccagcggcagcggccagggcctgagccccgacagaagagccagcctgctgaccagcctgatgctggtgaagagagactacagatacgacagagtgctgttctggggcagaatcctgggcctggtggccgactactacatcgcccagggcctgagcgaggaccagctggcccccagaaagaccctgtacagcctgaactgcaccgagtggagcctgctgccccccgccaccgaggagatggtggcccagagcagcgtggtgaagggcagattcatgggcgaccccagctacgagtacgagcacaccgagctgcagaaggtgaacgagggcgagaaggtgttcgaggaggagatcgtgatcgacaaggccgtggccatcatccccagaggcgccctgttcaagacccccttcggccccacccacgtgaacagaaccttcgagggcctgagcctgagcgaggccaagaagctgagcagctacttccacttcagagagcccgtggagctgaagaacaagaccctgctggagaaggccgacctggaccccagcctggacttcatggacagcctggagcacgacatccccaagggcagcgaggccgtggtgcagggcgacttcacctggctgctgagcagatgcggcttcggctggccctgcagctgggacagctgcagcgtgagcatgagagtgctggagcaccccgacggcgagggccagtgccccggcggcgccgcccagcccgccctggccggcccccacctgctgccctgcagcccccaccaggagctgtggctgagactgagaggccactggagagaggagcacggcctggccctgcacgccatcgagtgggagcccgcctggatgttcctgaacagagtgtag

SEQ ID NO: 96236 - DNA, 402 bp, Artificial Sequence
  Description of Artificial Sequence: Synthetic coding sequence
tgactgaactgcaccgagtggagcctgctgccccccgccaccgaggagatggtggcccagagcagcgtggtgaagggcagattcatgggcgaccccagctacgagtacgagcacaccgagctgcagaaggtgaacgagggcgagaaggtgttcgaggaggagatcgtggtgcagatcaaggaggagaccagactggtgagcgtgatcgaccagatcgacaaggccgtggccatcatccccagaggcgccctgttcaagacccccttcggccccacccacgtgaacagaaccttcgagggctactacaactggtacaagacccccgccccccaccccacctgcgacggcaaccagggcgtgagagccagaggcagaagccccagcctgggcagattcctgtag

SEQ ID NO: 96237 - DNA, 1086 bp, Artificial Sequence
  Description of Artificial Sequence: Synthetic coding sequence
atgtgggtgctgacccccgccgccttcgccggcaagctgctgagcgtgttcagacagcccctgagcagcctgtggagaagcctggtgcccctgttctgctggctgagagccaccttctggctgctggccaccaagagaagaaagcagcagctggtgctgagaggccccgacgagaccaaggaggaggaggaggacccccccctgcccaccacccccaccagcgtgaactaccacttcaccagacagtgcaactacaagtgcggcttctgcttccacaccgccaagaccagcttcgtgctgcccctggaggaggccaagagaggcctgctgctgctgaaggaggccggcatggagaagatcaacttcagcggcggcgagcccttcctgcaggacagaggcgagtacctgggcaagctggtgagattctgcaaggtggagctgagactgcccagcgtgagcatcgtgagcaacggcagcctgatcagagagagatggttccagaactacggcgagtacctggacatcctggccatcagctgcgacagcttcgacgaggaggtgaacgtgctgatcggcagaggccagggcaagaagaaccacgtggagaacctgcagaagctgagaagatggtgcagagactacagagtggccttcaagatcaacagcgtgatcaacagattcaacgtggaggaggacatgaccgagcagatcaaggccctgaaccccgtgagatggaaggtgttccagtgcctgctgatcgagggcgagaactgcggcgaggacgccctgagagaggccgagagattcgtgatcggcgacgaggagttcgagagattcctggagagacacaaggaggtgagctgcctggtgcccgagagcaaccagaagatgaaggacagctacctgatcctggacgagtacatgagattcctgaactgcagaaagggcagaaaggaccccagcaagagcatcctggacgtgggcgtggaggaggccatcaagttcagcggcttcgacgagaagatgttcctgaagagaggcggcaagtacatctggagcaaggccgacctgaagctggactggtag

SEQ ID NO: 96238 - DNA, 765 bp, Artificial Sequence
  Description of Artificial Sequence: Synthetic coding sequence
atgctgcacagcagccactaccccggcatggagaagatcaacttcagcggcggcgagcccttcctgcaggacagaggcgagtacctgggcaagctggtgagattctgcaaggtggagctgagactgcccagcgtgagcatcgtgagcaacggcagcctgatcagagagagatggttccagaactacggcgagtacctggacatcctggccatcagctgcgacagcttcgacgaggaggtgaacgtgctgatcggcagaggccagggcaagaagaaccacgtggagaacctgcagaagctgagaagatggtgcagagactacagagtggccttcaagatcaacagcgtgatcaacagattcaacgtggaggaggacatgaccgagcagatcaaggccctgaaccccgtgagatggaaggtgttccagtgcctgctgatcgagggcgagaactgcggcgaggacgccctgagagaggccgagagattcgtgatcggcgacgaggagttcgagagattcctggagagacacaaggaggtgagctgcctggtgcccgagagcaaccagaagatgaaggacagctacctgatcctggacgagtacatgagattcctgaactgcagaaagggcagaaaggaccccagcaagagcatcctggacgtgggcgtggaggaggccatcaagttcagcggcttcgacgagaagatgttcctgaagagaggcggcaagtacatctggagcaaggccgacctgaagctggactggtag

SEQ ID NO: 96239 - DNA, 1674 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcatctacctgctggacctgatctacatcgacagcgcctaccccgccagcggcagcatcatggagaacgagcagagaagcaaccagatgaacaacatcctgagaatcatcgccgacctgcaggtgagctgcagctacgaccacctgaccaccctgccccacgtgcagaagtacctgaagagcgtgagatacatcgaggagctgcagaagttcgtggaggacgacaactacaagctgagcctgagaatcgagcccggcagcagcagccccagactggtgagcagcaaggaggacctggccggccccagcgccggcagcggcagcgccagattcagcagaagacccacctgccccgacaccagcgtggccggcagcctgcccaccccccccgtgcccagacacagaaagagccacagcctgggcaacaacatgatgtgccagctgagcgtggtggagagcaagagcgccaccttccccagcgagaaggccagacacctgctggacgacagcgtgctggagagcagaagccccagaagaggcctggccctgaccagcagcagcgccgtgaccaacggcctgagcctgggcagcagcgagagcagcgagttcagcgaggagatgagcagcggcctggagagccccaccggcccctgcatctgcagcctgggcaacagcgccgccgtgcccaccatggagggccccctgagaagaaagaccctgctgaaggagggcagaaagcccgccctgagcagctggaccagatactgggtgatcctgagcggcagcaccctgctgtactacggcgccaagagcctgagaggcaccgacagaaagcactacaagagcacccccggcaagaaggtgagcatcgtgggctggatggtgcagctgcccgacgaccccgagcaccccgacatcttccagctgaacaaccccgacaagggcaacgtgtacaagttccagaccggcagcagattccacgccatcctgtggcacaagcacctggacgacgcctgcaagagcaacagaccccaggtgcccgccaacctgatgagcttcgagtag

SEQ ID NO: 96240 - DNA, 522 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgtag

SEQ ID NO: 96241 - DNA, 1590 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcatctacctgctggacctgatctacatcgacagcgcctaccccgccagcggcagcatcatggagaacgagcagagaagcaaccagatgaacaacatcctgagaatcatcgccgacctgcaggtgagctgcagctacgaccacctgaccaccctgccccacgtgcagaagtacctgaagagcgtgagatacatcgaggagctgcagaagttcgtggaggacgacaactacaagctgagcctgagaatcgagcccggcagcagcagccccagactggtgagcagcaaggaggacctggccggccccagcgccggcagcggcagcgccagattcagcagaagacccacctgccccgacaccagcgtggccggcagcctgcccaccccccccgtgcccagacacagaaagagccacagcctgggcaacaacagaggcagactgtacgccaccctgggccccaactggagagtgcccgtgagaaacagccccagaaccagaagctgcgtgtacagccccaccggcccctgcatctgcagcctgggcaacagcgccgccgtgcccaccatggagggccccctgagaagaaagaccctgctgaaggagggcagaaagcccgccctgagcagctggaccagatactgggtgatcctgagcggcagcaccctgctgtactacggcgccaagagcctgagaggcaccgacagaaagcacgtgagcatcgtgggctggatggtgcagctgcccgacgaccccgagcaccccgacatcttccagctgaacaaccccgacaagggcaacgtgtacaagttccagaccggcagcagattccacgccatcctgtggcacaagcacctggacgacgcctgcaagagcaacagaccccaggaggccggcgccgcccccggccccaccggcaccgacagccacgaggtggaccacctggagggcggcgccggcaaggaggccggcccctgcgcctag

SEQ ID NO: 96242 - DNA, 918 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcatctacctgctggacctgatctacatcgacagcgcctaccccgccagcggcagcatcatggagaacgagcagagaagcaaccagatgaacaacatcctgagaatcatcgccgacctgcaggtgagctgcagctacgaccacctgaccaccctgccccacgtgcagaagtacctgaagagcgtgagatacatcgaggagctgcagaagttcgtggaggacgacaactacaagctgagcctgagaatcgagcccggcagcagcagccccagactggtgagcagcaaggaggacctggccgccatgtag

SEQ ID NO: 96243 - DNA, 642 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcagaagcctgaactggctgatcttcttctag

SEQ ID NO: 96244 - DNA, 327 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgagaagggctggcccgccagaatggaggacagcctgcagaagagcaccgtgagcagcagaccccacgacaccctgcagttcagaaagaccctgcccgtgggccccggcacctag

SEQ ID NO: 96245 - DNA, 1155 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcatctacctgctggacctgatctacatcgacagcgcctaccccgccagcggcagcatcatggagaacgagcagagaagcaaccagatgaacaacatcctgagaatcatcgccgacctgcaggtgagctgcagctacgaccacctgaccaccctgccccacgtgcagaagtacctgaagagcgtgagatacatcgaggagctgcagaagttcgtggaggacgacaactacaagctgagcctgagaatcgagcccggcagcagcagccccagactggtgagcagcaaggaggacctggccgtgagccacctgagcagcctgagccaccagggccaggccgaggaggccagactgaagcccaccagcggccagcaccccgcctggatgtggcccagcagcagcagagtgcccgccgccccccccgccagcgccgcccccagaagcccctggcccagaaacctgagaaacgaccagggccagcccggcgccgtggccctgacctgcaaccccagcaccctgggcagcagaagcagaagaatcacctag

SEQ ID NO: 96246 - DNA, 1614 bp, Artificial Sequence
  Description of Artificial Sequence: Synthetic coding sequence
atgtacaagagaaacggcctgatggccagcgtgctggtgaccagcgccaccccccagggcagcagcagcagcgacagcctggagggccagagctgcgactacgccagcaagagctacgacgccgtggtgttcgacgtgctgaaggtgacccccgaggagttcgccagccagatcaccctgatggacatccccgtgttcaaggccatccagcccgaggagctggccagctgcggctggagcaagaaggagaagcacagcctggcccccaacgtggtggccttcaccagaagattcaaccaggtgagcttctgggtggtgagagagatcctgaccgcccagaccctgaagatcagagccgagatcctgagccacttcgtgaagatcgccaagaagctgctggagctgaacaacctgcacagcctgatgagcgtggtgagcgccctgcagagcgcccccatcttcagactgaccaagacctgggccctgctgaacagaaaggacaagaccaccttcgagaagctggactacctgatgagcaaggaggacaactacaagagaaccagagagtacatcagaagcctgaagatggtgcccagcatcccctacctgggcatctacctgctggacctgatctacatcgacagcgcctaccccgccagcggcagcatcatggagaacgagcagagaagcaaccagatgaacaacatcctgagaatcatcgccgacctgcaggtgagctgcagctacgaccacctgaccaccctgccccacgtgcagaagtacctgaagagcgtgagatacatcgaggagctgcagaagttcgtggaggacgacaactacaagctgagcctgagaatcgagcccggcagcagcagccccagactggtgagcagcaaggaggacctggccggccccagcgccggcagcggcagcgccagattcagcagaagacccacctgccccgacaccagcgtggccggcagcctgcccaccccccccgtgcccagacacagaaagagccacagcctgggcaacaacagaggcagactgtacgccaccctgggccccaactggagagtgcccgtgagaaacagccccagaaccagaagctgcgtgtacagccccaccggcccctgcatctgcagcctgggcaacagcgccgccgtgcccaccatggagggccccctgagaagaaagaccctgctgaaggagggcagaaagcccgccctgagcagctggaccagatactgggtgatcctgagcggcagcaccctgctgtactacggcgccaagagcctgagaggcaccgacagaaagcactacaagagcacccccggcaagaaggtgagcatcgtgggctggatggtgcagctgcccgacgaccccgagcaccccgacatcttccagctgaacaaccccgacaagggcaacgtgtacaagttccagaccggcagcagattccacgccatcctgtggcacaagcacctggacgacgcctgcaagagcaacagaccccaggaggccggcgccgcccccggccccaccggcaccgacagccacgaggtggaccacctggagggcggcgccggcaaggaggccggcccctgcgcctag

SEQ ID NO: 96247 - DNA, 462 bp, Artificial Sequence
  Description of Artificial Sequence: Synthetic coding sequence
tgaaacagccccagaaccagaagctgcgtgtacagccccaccggcccctgcatctgcagcctgggcaacagcgccgccgtgcccaccatggagggccccctgagaagaaagaccctgctgaaggagggcagaaagcccgccctgagcagctggaccagatactgggtgatcctgagcggcagcaccctgctgtactacggcgccaagagcctgagaggcaccgacagaaagcactacaagagcacccccggcaagaaggtgagcatcgtgggctggatggtgcagctgcccgacgaccccgagcaccccgacatcttccagctgaacaaccccgacaagggcaacgtgtacaagttccagaccggcagcagattccacgccatcctgtggcacaagcacctggacgacgcctgcaagagcaacagaccccaggtgcccgccaacctgatgagcttcgagtag

SEQ ID NO: 96248 - DNA, 6252 bp, Artificial Sequence
  Description of Artificial Sequence: Synthetic coding sequence
atgttcagcaagaagccccacggcgacgtgaagaagagcacccagaaggtgctggacaccaagaaggacgccctgaccagactgaagcacctgagaatcgtgatcgagaacgccgagagcatcgacctgaagcagttcttcgaccagcacttcagccacatctactacgtgttcttcgagaacttcgtgaccatcgaggccagcctgaagcagaagggccacaagagccagagagaggagctggacgccatcctgttcatcttcgagaagatcctgcagctgctgcccgagagaatccaccagagatggcagttccacagcatcggcctgatcctgaagaagctgctgcacaccggcaacagcctgaagatcagaagagagggcgtgagactgttcctgctgtggctgcaggccctgcagaacaactgcagcaaggagcagctgtggatgttcagctgcctgatccccggcttcagcgccccccagagcgagcacggccccagaaccctggacaacctgatcaacccccccctgaacctgcaggagacccaggtgaccatcgaggagatcacccccctggtgcccccccagagcggcgacaagggccaggaggacctgaccagctacttcctggaggccctgctgaagtacatcgtgatccaggtgaagagcctggagtggaagaacaaggagaaccaggagagaggcttcagcttcctgttcagccacttcaagaagtactacctgccctacatcttccccaacatctgcaaggagaacagcctgtaccaccccatcctggacatcccccagatgagacccaagccccactacgtggtgatcaagaaggacgccgagaccaacgaggccatctactgcaccaaggagcccttcatcaaggccagagtgatcgtgatcagatggctggtgagcttctggctggagcccaagccccacaccggcccccacatccccggcatggagggcgaggtgctgcccaagaacatccagagagccgccgccagcctggtgagcagagaggagagcaagaacgacaacgccgacaagaccgacagaaccaccgagcccgagcagagccacagcaacaccagcaccctgaccgagagagagcccagcagcagcagcctgtgcagcatcgacgaggagcacctgaccgacatcgagatcgtgagaagagtgttcagcagcaagagaagcaacgtgaacttcgtgaccgagatcttcagacaggccttcctgctgcccatctgcgaggccgccgccatgagaaaggtggtgaaggtgtaccaggagtggatccagcaggaggagaagcccctgttcatgcaggagcccgaggagatcgtgatcaccagcagcgacctgccctgcatcgagaacgtgaccgaccacgacatcagcatggaggagggcgagaagagagaggaggagaacggcaccaacaccgccgaccacgtgagaaacagcagctgggccaagaacggcagctaccagggcgccctgcacaacgccagcgaggaggccaccgagcagaacatcagagccggcacccaggccgtgctgcaggtgttcatcatcaacagcagcaacatcttcctgctggagcccgccaacgagatcaagaacctgctggacgagcacaccgacatgtgcaagagaatcctgaacatctacagatacatggtggtgcaggtgagcatggacaagaagacctgggagcagatgctgctggtgctgctgagagtgaccgagagcgtgctgaagatgcccagccaggccttcctgcagttccagggcaagaagaacatgaccctggccggcagactggccggccccctgttccagaccctgatcgtggcctggatcaaggccaacctgaacgtgtacatcagcagagagctgtgggacgacctgctgagcgtgctgagcagcctgacctactgggaggagctggccaccgagtggagcctgaccatggagaccctgaccaaggtgctggccagaaacctgtacagcctggacctgagcgacctgcccctggacaagctgagcgagcagaagcagaagaagcacaagggcaagggcgtgggccacgagttccagaaggtgagcgtggacaagagcttcagcagaggctggagcagagaccagcccggccaggcccccatgagacagagaagcgccaccaccaccggcagccccggcaccgagaaggccagaagcatcgtgagacagaagaccgtggccatgagaagcagaagcatcggcgagtgcgccctgcccagcgcctacatcagaagcgccaagagcgcccccgtgctgatccacaccagcaagcccttcctgcccgacatcgtgctgacccccctgagcgacgagctgagcgacatcgacgacgcccagatcctgcccagaagcaccagagtgagacacttcagccagagcgaggagaccggcaacgaggtgttcggcgccctgaacgaggagcagcccctgcccagaagcagcagcaccagcgacatcctggagcccttcaccgtggagagagccaaggtgaacaaggaggacatgagccagaagctgccccccctgaacagcgacatcggcggcagcagcgccaacgtgcccgacctgatggacgagttcatcgccgagagactgagaagcggcaacgccagcaccatgaccagaagaggcagcagccccggcagcctggagatccccaaggacctgcccgacatcctgaacaagcagaaccagatgagacccatcgacgaccccggcgtgcccagcgagtggaccagccccgccagcgccggcagcagcgacctgatcagcagcgacagccacagcgacagcttcagcgccttccagtacgacggcagaaagttcgacaacttcggcttcggcaccgacaccggcgtgaccagcagcgccgacgtggacagcggcagcggccaccaccagagcgccgaggagcaggaggtggccagcctgaccaccctgcacatcgacagcgagaccagcagcctgaaccagcaggccttcagcgccgaggtggccaccatcaccggcagcgagagcgccagccccgtgcacagccccctgggcagcagaagccagacccccagccccagcaccctgaacatcgaccacatggagcagaaggacctgcagctggacgagaagctgcaccacagcgtgctgcagacccccgacgacctggagatcagcgagttccccagcgagtgctgcagcgtgatggccggcggcaccctgaccggctggcacgccgacgtggccaccgtgatgtggagaagaatgctgggcatcctgggcgacgtgaacagcatcatggaccccgagatccacgcccaggtgttcgactacctgtgcgagctgtggcagaacctggccaagatcagagacaacctgggcatcagcaccgacaacctgaccagccccagcccccccgtgctgatcccccccctgagaatcctgaccccctggctgttcaaggccaccatgctgaccgacaagtacaagcagggcaagctgcacgcctacaagctgatctgcaacaccatgaagagaagacaggacgtgagccccaacagagacttcctgacccacttctacaacatcatgcactgcggcctgctgcacatcgaccaggacatcgtgaacaccatcatcaagcactgcagcccccagttcttcagcctgggcctgcccggcgccaccatgctgatcatggacttcatcgtggccgccggcagagtggccagcagcgccttcctgaacgcccccagagtggaggcccaggtgctgctgggcagcctggtgtgcttccccaacctgtactgcgagctgcccagcctgcaccccaacatccccgacgtggccgtgagccagttcaccgacgtgaaggagctgatcatcaagaccgtgctgagcagcgccagagacgagcccagcggccccgccagatgcgtggccctgtgcagcctgggcatctggatctgcgaggagctggtgcacgagagccaccacccccagatcaaggaggccctgaacgtgatctgcgtgagcctgaagttcaccaacaagaccgtggcccacgtggcctgcaacatgctgcacatgctggtgcactacgtgcccagactgcagatctaccagcccgacagccccctgaagatcatccagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccgaccactag

SEQ ID NO: 96249 - DNA, 6252 bp, Artificial Sequence
  Description of Artificial Sequence: Synthetic coding sequence
atgttcagcaagaagccccacggcgacgtgaagaagagcacccagaaggtgctggacaccaagaaggacgccctgaccagactgaagcacctgagaatcgtgatcgagaacgccgagagcatcgacctgaagcagttcttcgaccagcacttcagccacatctactacgtgttcttcgagaacttcgtgaccatcgaggccagcctgaagcagaagggccacaagagccagagagaggagctggacgccatcctgttcatcttcgagaagatcctgcagctgctgcccgagagaatccaccagagatggcagttccacagcatcggcctgatcctgaagaagctgctgcacaccggcaacagcctgaagatcagaagagagggcgtgagactgttcctgctgtggctgcaggccctgcagaacaactgcagcaaggagcagctgtggatgttcagctgcctgatccccggcttcagcgccccccagagcgagcacggccccagaaccctggacaacctgatcaacccccccctgaacctgcaggagacccaggtgaccatcgaggagatcacccccctggtgcccccccagagcggcgacaagggccaggaggacctgaccagctacttcctggaggccctgctgaagtacatcgtgatccaggtgaagagcctggagtggaagaacaaggagaaccaggagagaggcttcagcttcctgttcagccacttcaagaagtactacctgccctacatcttccccaacatctgcaaggagaacagcctgtaccaccccatcctggacatcccccagatgagacccaagccccactacgtggtgatcaagaaggacgccgagaccaacgaggccatctactgcaccaaggagcccttcatcaaggccagagtgatcgtgatcagatggctggtgagcttctggctggagcccaagccccacaccggcccccacatccccggcatggagggcgaggtgctgcccaagaacatccagagagccgccgccagcctggtgagcagagaggagagcaagaacgacaacgccgacaagaccgacagaaccaccgagcccgagcagagccacagcaacaccagcaccctgaccgagagagagcccagcagcagcagcctgtgcagcatcgacgaggagcacctgaccgacatcgagatcgtgagaagagtgttcagcagcaagagaagcaacgtgaacttcgtgaccgagatcttcagacaggccttcctgctgcccatctgcgaggccgccgccatgagaaaggtggtgaaggtgtaccaggagtggatccagcaggaggagaagcccctgttcatgcaggagcccgaggagatcgtgatcaccagcagcgacctgccctgcatcgagaacgtgaccgaccacgacatcagcatggaggagggcgagaagagagaggaggagaacggcaccaacaccgccgaccacgtgagaaacagcagctgggccaagaacggcagctaccagggcgccctgcacaacgccagcgaggaggccaccgagcagaacatcagagccggcacccaggccgtgctgcaggtgttcatcatcaacagcagcaacatcttcctgctggagcccgccaacgagatcaagaacctgctggacgagcacaccgacatgtgcaagagaatcctgaacatctacagatacatggtggtgcaggtgagcatggacaagaagacctgggagcagatgctgctggtgctgctgagagtgaccgagagcgtgctgaagatgcccagccaggccttcctgcagttccagggcaagaagaacatgaccctggccggcagactggccggccccctgttccagaccctgatcgtggcctggatcaaggccaacctgaacgtgtacatcagcagagagctgtgggacgacctgctgagcgtgctgagcagcctgacctactgggaggagctggccaccgagtggagcctgaccatggagaccctgaccaaggtgctggccagaaacctgtacagcctggacctgagcgacctgcccctggacaagctgagcgagcagaagcagaagaagcacaagggcaagggcgtgggccacgagttccagaaggtgagcgtggacaagagcttcagcagaggctggagcagagaccagcccggccaggcccccatgagacagagaagcgccaccaccaccggcagccccggcaccgagaaggccagaagcatcgtgagacagaagaccgtggacatcgacgacgcccagatcctgcccagaagcaccagagtgagacacttcagccagagcgaggagaccggcaacgaggtgttcggcgccctgaacgaggagcagcccctgcccagaagcagcagcaccagcgacatcctggagcccttcaccgtggagagagccaaggtgaacaaggaggacatgagccagaagctgccccccctgaacagcgacatcggcggcagcagcgccaacgtgcccgacctgatggacgagttcatcgccgagagactgagaagcggcaacgccagcaccatgaccagaagaggcagcagccccggcagcctggagatccccaaggacctgcccgacatcctgaacaagcagaaccagatgagacccatcgacgaccccggcgtgcccagcgagtggaccagccccgccagcgccggcagcagcgacctgatcagcagcgacagccacagcgacagcttcagcgccttccagtacgacggcagaaagttcgacaacttcggcttcggcaccgacaccggcgtgaccagcagcgccgacgtggacagcggcagcggccaccaccagagcgccgaggagcaggaggtggccagcctgaccaccctgcacatcgacagcgagaccagcagcctgaaccagcaggccttcagcgccgaggtggccaccatcaccggcagcgagagcgccagccccgtgcacagccccctgggcagcagaagccagacccccagccccagcaccctgaacatcgaccacatggagcagaaggacctgcagctggacgagaagctgcaccacagcgtgctgcagacccccgacgacctggagatcagcgagttccccagcgagtgctgcagcgtgatggccggcggcaccctgaccggctggcacgccgacgtggccaccgtgatgtggagaagaatgctgggcatcctgggcgacgtgaacagcatcatggaccccgagatccacgcccaggtgttcgactacctgtgcgagctgtggcagaacctggccaagatcagagacaacctgggcatcagcaccgacaacctgaccagccccagcccccccgtgctgatcccccccctgagaatcctgaccccctggctgttcaaggccaccatgctgaccgacaagtacaagcagggcaagctgcacgcctacaagctgatctgcaacaccatgaagagaagacaggacgtgagccccaacagagacttcctgacccacttctacaacatcatgcactgcggcctgctgcacatcgaccaggacatcgtgaacaccatcatcaagcactgcagcccccagttcttcagcctgggcctgcccggcgccaccatgctgatcatggacttcatcgtggccgccggcagagtggccagcagcgccttcctgaacgcccccagagtggaggcccaggtgctgctgggcagcctggtgtgcttccccaacctgtactgcgagctgcccagcctgcaccccaacatccccgacgtggccgtgagccagttcaccgacgtgaaggagctgatcatcaagaccgtgctgagcagcgccagagacgagcccagcggccccgccagatgcgtggccctgtgcagcctgggcatctggatctgcgaggagctggtgcacgagagccaccacccccagatcaaggaggccctgaacgtgatctgcgtgagcctgaagttcaccaacaagaccgtggcccacgtggcctgcaacatgctgcacatgctggtgcactacgtgcccagactgcagatctaccagcccgacagccccctgaagatcatccagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccggcagctaccccgagatcctgcccagcgagacccccaccgccacccaggtggacggcgccgacctggccagccccatgagccccagaaccagcaagagcagaatgagcatgaagctgagaagaagcagcggcagcgccaacaagagctag

SEQ ID NO: 96250 - DNA, 6222 bp, Artificial Sequence
  Description of Artificial Sequence: Synthetic coding sequence
atgttcagcaagaagccccacggcgacgtgaagaagagcacccagaaggtgctggacaccaagaaggacgccctgaccagactgaagcacctgagaatcgtgatcgagaacgccgagagcatcgacctgaagcagttcttcgaccagcacttcagccacatctactacgtgttcttcgagaacttcgtgaccatcgaggccagcctgaagcagaagggccacaagagccagagagaggagctggacgccatcctgttcatcttcgagaagatcctgcagctgctgcccgagagaatccaccagagatggcagttccacagcatcggcctgatcctgaagaagctgctgcacaccggcaacagcctgaagatcagaagagagggcgtgagactgttcctgctgtggctgcaggccctgcagaacaactgcagcaaggagcagctgtggatgttcagctgcctgatccccggcttcagcgccccccagagcgagcacggccccagaaccctggacaacctgatcaacccccccctgaacctgcaggagacccaggtgaccatcgaggagatcacccccctggtgcccccccagagcggcgacaagggccaggaggacctgaccagctacttcctggaggccctgctgaagtacatcgtgatccaggtgaagagcctggagtggaagaacaaggagaaccaggagagaggcttcagcttcctgttcagccacttcaagaagtactacctgccctacatcttccccaacatctgcaaggagaacagcctgtaccaccccatcctggacatcccccagatgagacccaagccccactacgtggtgatcaagaaggacgccgagaccaacgaggccatctactgcaccaaggagcccttcatcaaggccagagtgatcgtgatcagatggctggtgagcttctggctggagcccaagccccacaccggcccccacatccccggcatggagggcgaggtgctgcccaagaacatccagagagccgccgccagcctggtgagcagagaggagagcaagaacgacaacgccgacaagaccgacagaaccaccgagcccgagcagagccacagcaacaccagcaccctgaccgagagagagcccagcagcagcagcctgtgcagcatcgacgaggagcacctgaccgacatcgagatcgtgagaagagtgttcagcagcaagagaagcaacgtgaacttcgtgaccgagatcttcagacaggccttcctgctgcccatctgcgaggccgccgccatgagaaaggtggtgaaggtgtaccaggagtggatccagcaggaggagaagcccctgttcatgcaggagcccgaggagatcgtgatcaccagcagcgacctgccctgcatcgagaacgtgaccgaccacgacatcagcatggaggagggcgagaagagagaggaggagaacggcaccaacaccgccgaccacgtgagaaacagcagctgggccaagaacggcagctaccagggcgccctgcacaacgccagcgaggaggccaccgagcagaacatcagagccggcacccaggccgtgctgcaggtgttcatcatcaacagcagcaacatcttcctgctggagcccgccaacgagatcaagaacctgctggacgagcacaccgacatgtgcaagagaatcctgaacatctacagatacatggtggtgcaggtgagcatggacaagaagacctgggagcagatgctgctggtgctgctgagagtgaccgagagcgtgctgaagatgcccagccaggccttcctgcagttccagggcaagaagaacatgaccctggccggcagactggccggccccctgttccagaccctgatcgtggcctggatcaaggccaacctgaacgtgtacatcagcagagagctgtgggacgacctgctgagcgtgctgagcagcctgacctactgggaggagctggccaccgagtggagcctgaccatggagaccctgaccaaggtgctggccagaaacctgtacagcctggacctgagcgacctgcccctggacaagctgagcgagcagaagcagaagaagcacaagggcaagggcgtgggccacgagttccagaaggtgagcgtggacaagagcttcagcagaggctggagcagagaccagcccggccaggcccccatgagacagagaagcgccaccaccaccggcagccccggcaccgagaaggccagaagcatcgtgagacagaagaccgtggacatcgacgacgcccagatcctgcccagaagcaccagagtgagacacttcagccagagcgaggagaccggcaacgaggtgttcggcgccctgaacgaggagcagcccctgcccagaagcagcagcaccagcgacatcctggagcccttcaccgtggagagagccaaggtgaacaaggaggacatgagccagaagctgccccccctgaacagcgacatcggcggcagcagcgccaacgtgcccgacctgatggacgagttcatcgccgagagactgagaagcggcaacgccagcaccatgaccagaagaggcagcagccccggcagcctggagatccccaaggacctgcccgacatcctgaacaagcagaaccagatgagacccatcgacgaccccggcgtgcccagcgagtggaccagccccgccagcgccggcagcagcgacctgatcagcagcgacagccacagcgacagcttcagcgccttccagtacgacggcagaaagttcgacaacttcggcttcggcaccgacaccggcgtgaccagcagcgccgacgtggacagcggcagcggccaccaccagagcgccgaggagcaggaggtggccagcctgaccaccctgcacatcgacagcgagaccagcagcctgaaccagcaggccttcagcgccgaggtggccaccatcaccggcagcgagagcgccagccccgtgcacagccccctgggcagcagaagccagacccccagccccagcaccctgaacatcgaccacatggagcagaaggacctgcagctggacgagaagctgcaccacagcgtgctgcagacccccgacgacctggagatcagcgagttccccagcgagtgctgcagcgtgatggccggcggcaccctgaccggctggcacgccgacgtggccaccgtgatgtggagaagaatgctgggcatcctgggcgacgtgaacagcatcatggaccccgagatccacgcccaggtgttcgactacctgtgcgagctgtggcagaacctggccaagatcagagacaacctgggcatcagcaccgacaacctgaccagccccagcccccccgtgctgatcccccccctgagaatcctgaccccctggctgttcaaggccaccatgctgaccgacaagtacaagcagggcaagctgcacgcctacaagctgatctgcaacaccatgaagagaagacaggacgtgagccccaacagagacttcctgacccacttctacaacatcatgcactgcggcctgctgcacatcgaccaggacatcgtgaacaccatcatcaagcactgcagcccccagttcttcagcctgggcctgcccggcgccaccatgctgatcatggacttcatcgtggccgccggcagagtggccagcagcgccttcctgaacgcccccagagtggaggcccaggtgctgctgggcagcctggtgtgcttccccaacctgtactgcgagctgcccagcctgcaccccaacatccccgacgtggccgtgagccagttcaccgacgtgaaggagctgatcatcaagaccgtgctgagcagcgccagagacgagcccagcggccccgccagatgcgtggccctgtgcagcctgggcatctggatctgcgaggagctggtgcacgagagccaccacccccagatcaaggaggccctgaacgtgatctgcgtgagcctgaagttcaccaacaagaccgtggcccacgtggcctgcaacatgctgcacatgctggtgcactacgtgcccagactgcagatctaccagcccgacagccccctgaagatcatccagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccgaggagagaaacgccgtgatcgtgctgttcctgcccaagccccccctggagaacatcggccacctgaaggcccccacccagagattctaccccgtgaagctgccccagcagagaagatag

SEQ ID NO: 96251 - DNA, 6150 bp, Artificial Sequence
  Description of Artificial Sequence: Synthetic coding sequence
atgttcagcaagaagccccacggcgacgtgaagaagagcacccagaaggtgctggacaccaagaaggacgccctgaccagactgaagcacctgagaatcgtgatcgagaacgccgagagcatcgacctgaagcagttcttcgaccagcacttcagccacatctactacgtgttcttcgagaacttcgtgaccatcgaggccagcctgaagcagaagggccacaagagccagagagaggagctggacgccatcctgttcatcttcgagaagatcctgcagctgctgcccgagagaatccaccagagatggcagttccacagcatcggcctgatcctgaagaagctgctgcacaccggcaacagcctgaagatcagaagagagggcgtgagactgttcctgctgtggctgcaggccctgcagaacaactgcagcaaggagcagctgtggatgttcagctgcctgatccccggcttcagcgccccccagagcgagcacggccccagaaccctggacaacctgatcaacccccccctgaacctgcaggagacccaggtgaccatcgaggagatcacccccctggtgcccccccagagcggcgacaagggccaggaggacctgaccagctacttcctggaggccctgctgaagtacatcgtgatccaggtgaagagcctggagtggaagaacaaggagaaccaggagagaggcttcagcttcctgttcagccacttcaagaagtactacctgccctacatcttccccaacatctgcaaggagaacagcctgtaccaccccatcctggacatcccccagatgagacccaagccccactacgtggtgatcaagaaggacgccgagaccaacgaggccatctactgcaccaaggagcccttcatcaaggccagagtgatcgtgatcagatggctggtgagcttctggctggagcccaagccccacaccggcccccacatccccggcatggagggcgaggtgctgcccaagaacatccagagagccgccgccagcctggtgagcagagaggagagcaagaacgacaacgccgacaagaccgacagaaccaccgagcccgagcagagccacagcaacaccagcaccctgaccgagagagagcccagcagcagcagcctgtgcagcatcgacgaggagcacctgaccgacatcgagatcgtgagaagagtgttcagcagcaagagaagcaacgtgaacttcgtgaccgagatcttcagacaggccttcctgctgcccatctgcgaggccgccgccatgagaaaggtggtgaaggtgtaccaggagtggatccagcaggaggagaagcccctgttcatgcaggagcccgaggagatcgtgatcaccagcagcgacctgccctgcatcgagaacgtgaccgaccacgacatcagcatggaggagggcgagaagagagaggaggagaacggcaccaacaccgccgaccacgtgagaaacagcagctgggccaagaacggcagctaccagggcgccctgcacaacgccagcgaggaggccaccgagcagaacatcagagccggcacccaggccgtgctgcaggtgttcatcatcaacagcagcaacatcttcctgctggagcccgccaacgagatcaagaacctgctggacgagcacaccgacatgtgcaagagaatcctgaacatctacagatacatggtggtgcaggtgagcatggacaagaagacctgggagcagatgctgctggtgctgctgagagtgaccgagagcgtgctgaagatgcccagccaggccttcctgcagttccagggcaagaagaacatgaccctggccggcagactggccggccccctgttccagaccctgatcgtggcctggatcaaggccaacctgaacgtgtacatcagcagagagctgtgggacgacctgctgagcgtgctgagcagcctgacctactgggaggagctggccaccgagtggagcctgaccatggagaccctgaccaaggtgctggccagaaacctgtacagcctggacctgagcgacctgcccctggacaagctgagcgagcagaagcagaagaagcacaagggcaagggcgtgggccacgagttccagaaggtgagcgtggacaagagcttcagcagaggctggagcagagaccagcccggccaggcccccatgagacagagaagcgccaccaccaccggcagccccggcaccgagaaggccagaagcatcgtgagacagaagaccgtggacatcgacgacgcccagatcctgcccagaagcaccagagtgagacacttcagccagagcgaggagaccggcaacgaggtgttcggcgccctgaacgaggagcagcccctgcccagaagcagcagcaccagcgacatcctggagcccttcaccgtggagagagccaaggaggccgagcagaacgccaccagaggcagcaccgagggcagcgtgcagagctgcaacggcctgttctggaaggagagctgcagcgacatcggcggcagcagcgccaacgtgcccgacctgatggacgagttcatcgccgagagactgagaagcggcaacgccagcaccatgaccagaagaggcagcagccccggcagcctggagatccccaaggacctgcccgacatcctgaacaagcagaaccagatgagacccatcgacgaccccggcgtgcccagcgagtggaccagccccgccagcgccggcagcagcgacctgatcagcagcgacagccacagcgacagcttcagcgccttccagtacgacggcagaaagttcgacaacttcggcttcggcaccgacaccggcgtgaccagcagcgccgacgtggacagcggcagcggccaccaccagagcgccgaggagcaggaggtggccagcctgaccaccctgcacatcgacagcgagaccagcagcctgaaccagcaggccttcagcgccgaggtggccaccatcaccggcagcgagagcgccagccccgtgcacagccccctgggcagcagaagccagacccccagccccagcaccctgaacatcgaccacatggagcagaaggacctgcagctggacgagaagctgcaccacagcgtgctgcagacccccgacgacctggagatcagcgagttccccagcgagtgctgcagcgtgatggccggcggcaccctgaccggctggcacgccgacgtggccaccgtgatgtggagaagaatgctgggcatcctgggcgacgtgaacagcatcatggaccccgagatccacgcccaggtgttcgactacctgtgcgagctgtggcagaacctggccaagatcagagacaacctgggcatcagcaccgacaacctgaccagccccagcccccccgtgctgatcccccccctgagaatcctgaccccctggctgttcaaggccaccatgctgaccgacaagtacaagcagggcaagctgcacgcctacaagctgatctgcaacaccatgaagagaagacaggacgtgagccccaacagagacttcctgacccacttctacaacatcatgcactgcggcctgctgcacatcgaccaggacatcgtgaacaccatcatcaagcactgcagcccccagttcttcagcctgggcctgcccggcgccaccatgctgatcatggacttcatcgtggccgccggcagagtggccagcagcgccttcctgaacgcccccagagtggaggcccaggtgctgctgggcagcctggtgtgcttccccaacctgtactgcgagctgcccagcctgcaccccaacatccccgacgtggccgtgagccagttcaccgacgtgaaggagctgatcatcaagaccgtgctgagcagcgccagagacgagcccagcggccccgccagatgcgtggccctgtgcagcctgggcatctggatctgcgaggagctggtgcacgagagccaccacccccagatcaaggaggccctgaacgtgatctgcgtgagcctgaagttcaccaacaagaccgtggcccacgtggcctgcaacatgctgcacatgctggtgcactacgtgcccagactgcagatctaccagcccgacagccccctgaagatcatccagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccgaccactag

SEQ ID NO: 96252 - DNA, 6111 bp, Artificial Sequence
  Description of Artificial Sequence: Synthetic coding sequence
atgttcagcaagaagccccacggcgacgtgaagaagagcacccagaaggtgctggacaccaagaaggacgccctgaccagactgaagcacctgagaatcgtgatcgagaacgccgagagcatcgacctgaagcagttcttcgaccagcacttcagccacatctactacgtgttcttcgagaacttcgtgaccatcgaggccagcctgaagcagaagggccacaagagccagagagaggagctggacgccatcctgttcatcttcgagaagatcctgcagctgctgcccgagagaatccaccagagatggcagttccacagcatcggcctgatcctgaagaagctgctgcacaccggcaacagcctgaagatcagaagagagggcgtgagactgttcctgctgtggctgcaggccctgcagaacaactgcagcaaggagcagctgtggatgttcagctgcctgatccccggcttcagcgccccccagagcgagcacggccccagaaccctggacaacctgatcaacccccccctgaacctgcaggagacccaggtgaccatcgaggagatcacccccctggtgcccccccagagcggcgacaagggccaggaggacctgaccagctacttcctggaggccctgctgaagtacatcgtgatccaggtgaagagcctggagtggaagaacaaggagaaccaggagagaggcttcagcttcctgttcagccacttcaagaagtactacctgccctacatcttccccaacatctgcaaggagaacagcctgtaccaccccatcctggacatcccccagatgagacccaagccccactacgtggtgatcaagaaggacgccgagaccaacgaggccatctactgcaccaaggagcccttcatcaaggccagagtgatcgtgatcagatggctggtgagcttctggctggagcccaagccccacaccggcccccacatccccggcatggagggcgaggtgctgcccaagaacatccagagagccgccgccagcctggtgagcagagaggagagcaagaacgacaacgccgacaagaccgacagaaccaccgagcccgagcagagccacagcaacaccagcaccctgaccgagagagagcccagcagcagcagcctgtgcagcatcgacgaggagcacctgaccgacatcgagatcgtgagaagagtgttcagcagcaagagaagcaacgtgaacttcgtgaccgagatcttcagacaggccttcctgctgcccatctgcgaggccgccgccatgagaaaggtggtgaaggtgtaccaggagtggatccagcaggaggagaagcccctgttcatgcaggagcccgaggagatcgtgatcaccagcagcgacctgccctgcatcgagaacgtgaccgaccacgacatcagcatggaggagggcgagaagagagaggaggagaacggcaccaacaccgccgaccacgtgagaaacagcagctgggccaagaacggcagctaccagggcgccctgcacaacgccagcgaggaggccaccgagcagaacatcagagccggcacccaggccgtgctgcaggtgttcatcatcaacagcagcaacatcttcctgctggagcccgccaacgagatcaagaacctgctggacgagcacaccgacatgtgcaagagaatcctgaacatctacagatacatggtggtgcaggtgagcatggacaagaagacctgggagcagatgctgctggtgctgctgagagtgaccgagagcgtgctgaagatgcccagccaggccttcctgcagttccagggcaagaagaacatgaccctggccggcagactggccggccccctgttccagaccctgatcgtggcctggatcaaggccaacctgaacgtgtacatcagcagagagctgtgggacgacctgctgagcgtgctgagcagcctgacctactgggaggagctggccaccgagtggagcctgaccatggagaccctgaccaaggtgctggccagaaacctgtacagcctggacctgagcgacctgcccctggacaagctgagcgagcagaagcagaagaagcacaagggcaagggcgtgggccacgagttccagaaggtgagcgtggacaagagcttcagcagaggctggagcagagaccagcccggccaggcccccatgagacagagaagcgccaccaccaccggcagccccggcaccgagaaggccagaagcatcgtgagacagaagaccgtggacatcgacgacgcccagatcctgcccagaagcaccagagtgagacacttcagccagagcgaggagaccggcaacgaggtgttcggcgccctgaacgaggagcagcccctgcccagaagcagcagcaccagcgacatcctggagcccttcaccgtggagagagccaaggtgaacaaggaggacatgagccagaagctgccccccctgaacagcgacatcggcggcagcagcgccaacgtgcccgacctgatggacgagttcatcgccgagagactgagaagcggcaacgccagcaccatgaccagaagaggcagcagccccggcagcctggagatccccaaggacctgcccgacatcctgaacaagcagaaccagatgagacccatcgacgaccccggcgtgcccagcgagtggaccagccccgccagcgccggcagcagcgacctgatcagcagcgacagccacagcgacagcttcagcgccttccagtacgacggcagaaagttcgacaacttcggcttcggcaccgacaccggcgtgaccagcagcgccgacgtggacagcggcagcggccaccaccagagcgccgaggagcaggaggtggccagcctgaccaccctgcacatcgacagcgagaccagcagcctgaaccagcaggccttcagcgccgaggtggccaccatcaccggcagcgagagcgccagccccgtgcacagccccctgggcagcagaagccagacccccagccccagcaccctgaacatcgaccacatggagcagaaggacctgcagctggacgagaagctgcaccacagcgtgctgcagacccccgacgacctggagatcagcgagttccccagcgagtgctgcagcgtgatggccggcggcaccctgaccggctggcacgccgacgtggccaccgtgatgtggagaagaatgctgggcatcctgggcgacgtgaacagcatcatggaccccgagatccacgcccaggtgttcgactacctgtgcgagctgtggcagaacctggccaagatcagagacaacctgggcatcagcaccgacaacctgaccagccccagcccccccgtgctgatcccccccctgagaatcctgaccccctggctgttcaaggccaccatgctgaccgacaagtacaagcagggcaagctgcacgcctacaagctgatctgcaacaccatgaagagaagacaggacgtgagccccaacagagacttcctgacccacttctacaacatcatgcactgcggcctgctgcacatcgaccaggacatcgtgaacaccatcatcaagcactgcagcccccagttcttcagcctgggcctgcccggcgccaccatgctgatcatggacttcatcgtggccgccggcagagtggccagcagcgccttcctgaacgcccccagagtggaggcccaggtgctgctgggcagcctggtgtgcttccccaacctgtactgcgagctgcccagcctgcaccccaacatccccgacgtggccgtgagccagttcaccgacgtgaaggagctgatcatcaagaccgtgctgagcagcgccagagacgagcccagcggccccgccagatgcgtggccctgtgcagcctgggcatctggatctgcgaggagctggtgcacgagagccaccacccccagatcaaggaggccctgaacgtgatctgcgtgagcctgaagttcaccaacaagaccgtggcccacgtggcctgcaacatgctgcacatgctggtgcactacgtgcccagactgcagatctaccagcccgacagccccctgaagatcatccagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccgaccactag

SEQ ID NO: 96253 - DNA, 6252 bp, Artificial Sequence; identical to SEQ ID NO: 96248
  Description of Artificial Sequence: Synthetic coding sequence

SEQ ID NO: 96254 - DNA, 2169 bp, Artificial Sequence
  Description of Artificial Sequence: Synthetic coding sequence
cagatcctgatcgccaccatcacccacctgctgcccagcaccgaggccagcagctacgagatggacaagagactggtggtgagcctgctgctgtgcctgctggactggatcatggccctgcccctgaagaccctgctgcagcccttccacgccaccggcgccgagagcgacaagaccgagaagagcgtgctgaactgcatctacaaggtgctgcacggctgcgtgtacggcgcccagtgcttcagcaaccccagatacttccccatgagcctgagcgacctggccagcgtggactacgaccccttcatgcacctggagagcctgaaggagcccgagcccctgcacagccccgacagcgagagaagcagcaagctgcagcccgtgaccgaggtgaagacccagatgcagcacggcctgatcagcatcgccgccagaaccgtgatcacccacctggtgaaccacctgggccactaccccatgagcggcggccccgccatgctgaccagccaggtgtgcgagaaccacgacaaccactacagcgagagcaccgagctgagccccgagctgttcgagagccccaacatccagttcttcgtgctgaacaacaccaccctggtgagctgcatccagatcagaagcgaggagaacatgcccggcggcggcctgagcgccggcctggccagcgccaacagcaacgtgagaatcatcgtgagagacctgagcggcaagtacagctgggacagcgccatcctgtacggccccccccccgtgagcggcctgagcgagcccaccagcttcatgctgagcctgagccaccaggagaagcccgaggagccccccaccagcaacgagtgcctggaggacatcaccgtgaaggacggcctgagcctgcagttcaagagattcagagagaccgtgcccacctgggacaccatcagagacgaggaggacgtgctggacgagctgctgcagtacctgggcgtgaccagccccgagtgcctgcagagaaccggcatcagcctgaacatccccgccccccagcccgtgtgcatcagcgagaagcaggagaacgacgtgatcaacgccatcctgaagcagcacaccgaggagaaggagttcgtggagaagcacttcaacgacctgaacatgaaggccgtggagcaggacgagcccatcccccagaagccccagagcgccttctactactgcagactgctgctgagcatcctgggcatgaacagctgggacaagagaagaagcttccacctgctgaagaagaacgagaagctgctgagagagctgagaaacctggacagcagacagtgcagagagacccacaagatcgccgtgttctacgtggccgagggccaggaggacaagcacagcatcctgaccaacaccggcggcagccaggcctacgaggacttcgtggccggcctgggctgggaggtgaacctgaccaaccactgcggcttcatgggcggcctgcagaagaacaagagcaccggcctgaccaccccctacttcgccaccagcaccgtggaggtgatcttccacgtgagcaccagaatgcccagcgacagcgacgacagcctgaccaagaagctgagacacctgggcaacgacgaggtgcacatcgtgtggagcgagcacaccagagactacagaagaggcatcatccccaccgagttcggcgacgtgctgatcgtgatctaccccatgaagaaccacatgttcagcatccagatcatgaagaagcccgaggtgcccttcttcggccccctgttcgacggcgccatcgtgaacggcaaggtgctgcccatcatggtgagagccaccgccatcaacgccagcagagccctgaagagcctgatccccctgtaccagaacttctacgaggagagagccagatacctgcagaccatcgtgcagcaccacctggagcccaccaccttcgaggacttcgccgcccaggtgttcagccccgccccctaccaccacctgcccagcgacgccgtgggcagctaccccgagatcctgcccagcgagacccccaccgccacccaggtggacggcgccgacctggccagccccatgagccccagaaccagcaagagcagaatgagcatgaagctgagaagaagcagcggcagcgccaacaagagctag

SEQ ID NO: 96255 - DNA, 2709 bp, Artificial Sequence
  Description of Artificial Sequence: Synthetic coding sequence
atggtgcagagaatgtgggccgaggccgccggccccgccggcggcgccgagcccctgttccccggcagcagaagaagcagaagcgtgtgggacgccgtgagactggaggtgggcgtgcccgacagctgccccgtggtgctgcacagcttcacccagctggaccccgacctgcccagacccgagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96256 - DNA, 2745 bp, Artificial Sequence
  Description of Artificial Sequence: Synthetic coding sequence
atggtgcagagaatgtgggccgaggccgccggccccgccggcggcgccgagcccctgttccccggcagcagaagaagcagaagcgtgtgggacgccgtgagactggaggtgggcgtgcccgacagctgccccgtggtgctgcacagcttcacccagctggaccccgacctgcccagacccgagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggcagatgcgacgccctgaccgccagcagcagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96257 - DNA, 1341 bp, Artificial Sequence
  Description of Artificial Sequence: Synthetic coding sequence
atgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagacctag

SEQ ID NO: 96258 - DNA, 2658 bp, Artificial Sequence
  Description of Artificial Sequence: Synthetic coding sequence
atgtgcctgtggggccacagcaccgcccccgcccacaccctgagcagcccccccctgctgttctgcagcctgccctgcgccctgcacctgcagcccggcaccggccacccccccggccaggtgcccagaaagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96259 - DNA, 2742 bp, Artificial Sequence
  Description of Artificial Sequence: Synthetic coding sequence
atggccagagaggccggccaggtgtgcgccagacccgccgtgcccagaggcagaaagggcagcgtgttcttcgcctgcgtgagcgtggtgaccgccagaagaagagccgtggccagaagagccgccctgcagagccccaccccctggctggcccccctgcccgcccccgccaccaccgagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggcagatgcgacgccctgaccgccagcagcagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96260 - DNA, 2580 bp, Artificial Sequence
  Description of Artificial Sequence: Synthetic coding sequence
atgatggtggactgccagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggcagatgcgacgccctgaccgccagcagcagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96261 - DNA, 930 bp, Artificial Sequence
  Description of Artificial Sequence: Synthetic coding sequence
gtggtggccgagaacggcctgagcgaggagaagccccacctgctggtgttcccccccgacctggtggccgagcagttcaccctgatggacgccgagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagacctag

SEQ ID NO: 96262 - DNA, 2958 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcctgcccatgatgatggccctgagctgcctgtgccaccagcagcacgaggccgccctgcaggagggcgaggccacccccgccagaggcatggtgaccgtgcccagcgcccaggccgccggcgcccaggcccacaccgccgccgacacccacaccctggtgggcgcccacagactgagaggcaacctgcagcccagagccagcgccgcccacctgcccgccaccgagcccgaccactggggccacggcgtgtgcagaggcgagagcagcacccaggagatcggcgaggagctgatcaacggcgtgatctacagcatcagcctgagaaaggtgcagctgcaccacggcggcaacaagggccagagatggctgggctacgagaacgagagcgccctgaacctgtacgagacctgcaaggtgagaaccgtgaaggccggcaccctggagaagctggtggagcacctggtgcccgccttccagggcagcgacctgagctacgtgaccatcttcctgtgcacctacagagccttcaccaccacccagcaggtgctggacctgctgttcaagagatacggcagatgcgacgccctgaccgccagcagcagatacggctgcatcctgccctacagcgacgaggacggcggcccccaggaccagctgaagaacgccatcagcagcatcctgggcacctggctggaccagtacagcgaggacttctgccagccccccgacttcccctgcctgaagcagctggtggcctacgtgcagctgaacatgcccggcagcgacctggagagaagagcccacctgctgctggcccagctggagcacagcgagcccatcgaggccgagcccgaggccctgagccccgtgcccgccctgaagcccacccccgagctggagctggccctgacccccgccagagcccccagccccgtgcccgcccccgcccccgagcccgagcccgcccccacccccgcccccggcagcgagctggaggtggcccccgcccccgcccccgagctgcagcaggcccccgagcccgccgtgggcctggagagcgcccccgcccccgccctggagctggagcccgcccccgagcaggaccccgcccccagccagaccctggagctggagcccgcccccgcccccgtgcccagcctgcagcccagctggcccagccccgtggtggccgagaacggcctgagcgaggagaagccccacctgctggtgttcccccccgacctggtggccgagcagttcaccctgatggacgccgagctgttcaagaaggtggtgccctaccactgcctgggcagcatctggagccagagagacaagaagggcaaggagcacctggcccccaccatcagagccaccgtgacccagttcaacagcgtggccaactgcgtgatcaccacctgcctgggcaacagaagcaccaaggcccccgacagagccagagtggtggagcactggatcgaggtggccagagagtgcagaatcctgaagaacttcagcagcctgtacgccatcctgagcgccctgcagagcaacagcatccacagactgaagaagacctgggaggacgtgagcagagacagcttcagaatcttccagaagctgagcgagatcttcagcgacgagaacaactacagcctgagcagagagctgctgatcaaggagggcaccagcaagttcgccaccctggagatgaaccccaagagagcccagaagagacccaaggagaccggcatcatccagggcaccgtgccctacctgggcaccttcctgaccgacctggtgatgctggacaccgccatgaaggactacctgtacggcagactgatcaacttcgagaagagaagaaaggagttcgaggtgatcgcccagatcaagctgctgcagagcgcctgcaacaactacagcatcgcccccgacgagcagttcggcgcctggttcagagccgtggagagactgagcgagaccgagagctacaacctgagctgcgagctggagccccccagcgagagcgccagcaacaccctgagaaccaagaagaacaccgccatcgtgaagagatggagcgacagacaggcccccagcaccgagctgagcaccagcggcagcagccacagcaagagctgcgaccagctgagatgcggcccctacctgagcagcggcgacatcgccgacgccctgagcgtgcacagcgccggcagcagcagcagcgacgtggaggagatcaacatcagcttcgtgcccgagagccccgacggccaggagaagaagttctgggagagcgccagccagagcagccccgagaccagcggcatcagcagcgccagcagcagcaccagcagcagcagcgccagcaccacccccgtggccgccaccagaacccacaagagaagcgtgagcggcctgtgcaacagcagcagcgccctgcccctgtacaaccagcaggtgggcgactgctgcatcatcagagtgagcctggacgtggacaacggcaacatgtacaagagcatcctggtgaccagccaggacaaggcccccgccgtgatcagaaaggccatggacaagcacaacctggaggaggaggagcccgaggactacgagctgctgcagatcctgagcgacgacagaaagctgaagatccccgagaacgccaacgtgttctacgccatgaacagcaccgccaactacgacttcgtgctgaagaagagaaccttcaccaagggcgtgaaggtgaagcacggcgccagcagcaccctgcccagaatgaagcagaagggcctgaagatcgccaagggcatcttctag

SEQ ID NO: 96263 - DNA, 2412 bp, Artificial Sequence
  Description of Artificial Sequence: Synthetic coding sequence
atggaggtgaagcccgtgggcgagcccacccaggaggtgagcaagttcaagctgagcaccaaggtggagagcaccggccactggctggtggaggaccacgtgagaatctgggaggtgctgaagaccgaggagagcagcatccaggactggggcgaggaggtggaggagggcgccgtgtaccacgtgaccctgaagagagtgcagatccagcaggccgccaacaagggcgccagatggctgggcgtggagggcgaccagctgccccccggccacaccgtgagccagtacgagacctgcaagatcagaaccatcaaggccggcaccctggagaagctggtggagaacctgctgaccgccttcggcgacaacgacttcacctacatcagcatcttcctgagcacctacagaggcttcgccagcaccaaggaggtgctggagctgctgctggacagatacggcaacctgaccagccccaactgcgaggaggacggcagccagagcagcagcgagagcaagatggtgatcagaaacgccatcgccagcatcctgagagcctggctggaccagtgcgccgaggacttcagagagcccccccacttcccctgcctgcagaagctgctggactacctgaccagaatgatgcccggcagcgaccccgagagaagagcccagaacctgctggagcagttccagaagcaggaggtggagaccgacaacggcctgcccaacaccatcagcttcagcctggaggaggaggaggagctggagggcggcgagagcgccgagttcacctgcttcagcgaggacctggtggccgagcagctgacctacatggacgcccagctgttcaagaaggtggtgccccaccactgcctgggctgcatctggagcagaagagacaagaaggagaacaagcacctggcccccaccatcagagccaccatcagccagttcaacaccctgaccaagtgcgtggtgagcaccatcctgggcggcaaggagctgaagacccagcagagagccaagatcatcgagaagtggatcaacatcgcccacgagtgcagactgctgaagaacttcagcagcctgagagccatcgtgagcgccctgcagagcaacagcatctacagactgaagaagacctgggccgccgtgcccagagacagaatgctgatgttcgaggagctgagcgacatcttcagcgaccacaacaaccacctgaccagcagagagctgctgatgaaggagggcaccagcaagttcgccaacctggacagcagcgtgaaggagaaccagaagagaacccagagaagactgcagctgcagaaggacatgggcgtgatgcagggcaccgtgccctacctgggcaccttcctgaccgacctgaccatgctggacaccgccctgcaggactacatcgagggcggcctgatcaacttcgagaagagaagaagagagttcgaggtgatcgcccagatcaagctgctgcagagcgcctgcaacagctactgcatgacccccgaccagaagttcatccagtggttccagagacagcagctgctgaccgaggaggagagctacgccctgagctgcgagatcgaggccgccgccgacgccagcaccaccagccccaagcccagaaagagcatggtgaagagactgagcctgctgttcctgggcagcgacatgatcaccagccccacccccaccaaggagcagcccaagagcaccgccagcggcagcagcggcgagagcatggacagcgtgagcgtgagcagctgcgagagcaaccacagcgaggccgaggagggcagcatcacccccatggacacccccgacgagccccagaagaagctgagcgagagcagcagcagctgcagcagcatccacagcatggacaccaacagcagcggcatgagcagcctgatcaaccccctgagcagcccccccagctgcaacaacaaccccaagatccacaagagaagcgtgagcgtgaccagcatcaccagcaccgtgctgccccccgtgtacaaccagcagaacgaggacacctgcatcatcagaatcagcgtggaggacaacaacggcaacatgtacaagagcatcatgctgaccagccaggacaagacccccgccgtgatccagagagccatgctgaagcacaacctggacagcgaccccgccgaggagtacgagctggtgcaggtgatcagcgaggacaaggagctggtgatccccgacagcgccaacgtgttctacgccatgaacagccaggtgaacttcgacttcatcctgagaaagaagaacagcatggaggagcaggtgaagctgagaagcagaaccagcctgaccctgcccagaaccgccaagagaggctgctggagcaacagacacagcaagatcaccctgtag

SEQ ID NO: 96264 - DNA, 2307 bp, Artificial Sequence
  Description of Artificial Sequence: Synthetic coding sequence
atgaagctgctgtggcaggccaagatgagcagcatccaggactggggcgaggaggtggaggagggcgccgtgtaccacgtgaccctgaagagagtgcagatccagcaggccgccaacaagggcgccagatggctgggcgtggagggcgaccagctgccccccggccacaccgtgagccagtacgagacctgcaagatcagaaccatcaaggccggcaccctggagaagctggtggagaacctgctgaccgccttcggcgacaacgacttcacctacatcagcatcttcctgagcacctacagaggcttcgccagcaccaaggaggtgctggagctgctgctggacagatacggcaacctgaccagccccaactgcgaggaggacggcagccagagcagcagcgagagcaagatggtgatcagaaacgccatcgccagcatcctgagagcctggctggaccagtgcgccgaggacttcagagagcccccccacttcccctgcctgcagaagctgctggactacctgaccagaatgatgcccggcagcgaccccgagagaagagcccagaacctgctggagcagttccagaagcaggaggtggagaccgacaacggcctgcccaacaccatcagcttcagcctggaggaggaggaggagctggagggcggcgagagcgccgagttcacctgcttcagcgaggacctggtggccgagcagctgacctacatggacgcccagctgttcaagaaggtggtgccccaccactgcctgggctgcatctggagcagaagagacaagaaggagaacaagcacctggcccccaccatcagagccaccatcagccagttcaacaccctgaccaagtgcgtggtgagcaccatcctgggcggcaaggagctgaagacccagcagagagccaagatcatcgagaagtggatcaacatcgcccacgagtgcagactgctgaagaacttcagcagcctgagagccatcgtgagcgccctgcagagcaacagcatctacagactgaagaagacctgggccgccgtgcccagagacagaatgctgatgttcgaggagctgagcgacatcttcagcgaccacaacaaccacctgaccagcagagagctgctgatgaaggagggcaccagcaagttcgccaacctggacagcagcgtgaaggagaaccagaagagaacccagagaagactgcagctgcagaaggacatgggcgtgatgcagggcaccgtgccctacctgggcaccttcctgaccgacctgaccatgctggacaccgccctgcaggactacatcgagggcggcctgatcaacttcgagaagagaagaagagagttcgaggtgatcgcccagatcaagctgctgcagagcgcctgcaacagctactgcatgacccccgaccagaagttcatccagtggttccagagacagcagctgctgaccgaggaggagagctacgccctgagctgcgagatcgaggccgccgccgacgccagcaccaccagccccaagcccagaaagagcatggtgaagagactgagcctgctgttcctgggcagcgacatgatcaccagccccacccccaccaaggagcagcccaagagcaccgccagcggcagcagcggcgagagcatggacagcgtgagcgtgagcagctgcgagagcaaccacagcgaggccgaggagggcagcatcacccccatggacacccccgacgagccccagaagaagctgagcgagagcagcagcagctgcagcagcatccacagcatggacaccaacagcagcggcatgagcagcctgatcaaccccctgagcagcccccccagctgcaacaacaaccccaagatccacaagagaagcgtgagcgtgaccagcatcaccagcaccgtgctgccccccgtgtacaaccagcagaacgaggacacctgcatcatcagaatcagcgtggaggacaacaacggcaacatgtacaagagcatcatgctgaccagccaggacaagacccccgccgtgatccagagagccatgctgaagcacaacctggacagcgaccccgccgaggagtacgagctggtgcaggtgatcagcgaggacaaggagctggtgatccccgacagcgccaacgtgttctacgccatgaacagccaggtgaacttcgacttcatcctgagaaagaagaacagcatggaggagcaggtgaagctgagaagcagaaccagcctgaccctgcccagaaccgccaagagaggctgctggagcaacagacacagcaagatcaccctgtag

SEQ ID NO: 96265 - DNA, 2412 bp, Artificial Sequence; identical to SEQ ID NO: 96263
  Description of Artificial Sequence: Synthetic coding sequence

SEQ ID NO: 96266 - DNA, 2301 bp, Artificial Sequence
  Description of Artificial Sequence: Synthetic coding sequence
atggaggtgaagcccgtgggcgagcccacccaggaggtgagcaagttcaagctgagcaccaaggtggagagcaccggccactggctggtggaggaccacgtgagaatctgggaggtgctgaagaccgaggaggtggagggcgaccagctgccccccggccacaccgtgagccagtacgagacctgcaagatcagaaccatcaaggccggcaccctggagaagctggtggagaacctgctgaccgccttcggcgacaacgacttcacctacatcagcatcttcctgagcacctacagaggcttcgccagcaccaaggaggtgctggagctgctgctggacagatacggcaacctgaccagccccaactgcgaggaggacggcagccagagcagcagcgagagcaagatggtgatcagaaacgccatcgccagcatcctgagagcctggctggaccagtgcgccgaggacttcagagagcccccccacttcccctgcctgcagaagctgctggactacctgaccagaatgatgcccggcagcgaccccgagagaagagcccagaacctgctggagcagttccagaagcaggaggtggagaccgacaacggcctgcccaacaccatcagcttcagcctggaggaggaggaggagctggagggcggcgagagcgccgagttcacctgcttcagcgaggacctggtggccgagcagctgacctacatggacgcccagctgttcaagaaggtggtgccccaccactgcctgggctgcatctggagcagaagagacaagaaggagaacaagcacctggcccccaccatcagagccaccatcagccagttcaacaccctgaccaagtgcgtggtgagcaccatcctgggcggcaaggagctgaagacccagcagagagccaagatcatcgagaagtggatcaacatcgcccacgagtgcagactgctgaagaacttcagcagcctgagagccatcgtgagcgccctgcagagcaacagcatctacagactgaagaagacctgggccgccgtgcccagagacagaatgctgatgttcgaggagctgagcgacatcttcagcgaccacaacaaccacctgaccagcagagagctgctgatgaaggagggcaccagcaagttcgccaacctggacagcagcgtgaaggagaaccagaagagaacccagagaagactgcagctgcagaaggacatgggcgtgatgcagggcaccgtgccctacctgggcaccttcctgaccgacctgaccatgctggacaccgccctgcaggactacatcgagggcggcctgatcaacttcgagaagagaagaagagagttcgaggtgatcgcccagatcaagctgctgcagagcgcctgcaacagctactgcatgacccccgaccagaagttcatccagtggttccagagacagcagctgctgaccgaggaggagagctacgccctgagctgcgagatcgaggccgccgccgacgccagcaccaccagccccaagcccagaaagagcatggtgaagagactgagcctgctgttcctgggcagcgacatgatcaccagccccacccccaccaaggagcagcccaagagcaccgccagcggcagcagcggcgagagcatggacagcgtgagcgtgagcagctgcgagagcaaccacagcgaggccgaggagggcagcatcacccccatggacacccccgacgagccccagaagaagctgagcgagagcagcagcagctgcagcagcatccacagcatggacaccaacagcagcggcatgagcagcctgatcaaccccctgagcagcccccccagctgcaacaacaaccccaagatccacaagagaagcgtgagcgtgaccagcatcaccagcaccgtgctgccccccgtgtacaaccagcagaacgaggacacctgcatcatcagaatcagcgtggaggacaacaacggcaacatgtacaagagcatcatgctgaccagccaggacaagacccccgccgtgatccagagagccatgctgaagcacaacctggacagcgaccccgccgaggagtacgagctggtgcaggtgatcagcgaggacaaggagctggtgatccccgacagcgccaacgtgttctacgccatgaacagccaggtgaacttcgacttcatcctgagaaagaagaacagcatggaggagcaggtgaagctgagaagcagaaccagcctgaccctgcccagaaccgccaagagaggctgctggagcaacagacacagcaagatcaccctgtag

SEQ ID NO: 96267 - DNA, 2220 bp, Artificial Sequence
  Description of Artificial Sequence: Synthetic coding sequence
atgaagctgctgtggcaggccaagatgagcagcatccaggactggggcgaggaggtggaggagggcgccgtgtaccacgtgaccctgaagagagtgcagatccagcaggccgccaacaagggcgccagatggctgggcgtggagggcgaccagctgccccccggccacaccgtgagccagtacgagacctgcaagatcagaaccatcaaggccggcaccctggagaagctggtggagaacctgctgaccgccttcggcgacaacgacttcacctacatcagcatcttcctgagcacctacagaggcttcgccagcaccaaggaggtgctggagctgctgctggacagatacggcaacctgaccagccccaactgcgaggaggacggcagccagagcagcagcgagagcaagatggtgatcagaaacgccatcgccagcatcctgagagcctggctggaccagtgcgccgaggacttcagagagcccccccacttcccctgcctgcagaagctgctggactacctgaccagaatgatgcccggcagcgaccccgagagaagagcccagaacctgctggagcagttccagaagcaggaggtggagaccgacaacggcctgcccaacaccatcagcttcagcctggaggaggaggaggagctggagggcggcgagagcgccgagttcacctgcttcagcgaggacctggtggccgagcagctgacctacatggacgcccagctgttcaagaaggtggtgccccaccactgcctgggctgcatctggagcagaagagacaagaaggagaacaagcacctggcccccaccatcagagccaccatcagccagttcaacaccctgaccaagtgcgtggtgagcaccatcctgggcggcaaggagctgaagacccagcagagagccaagatcatcgagaagtggatcaacatcgcccacgagtgcagactgctgaagaacttcagcagcctgagagccatcgtgagcgccctgcagagcaacagcatctacagactgaagaagacctgggccgccgtgcccagagacagaatgctgatgttcgaggagctgagcgacatcttcagcgaccacaacaaccacctgaccagcagagagctgctgatgaaggagggcaccagcaagttcgccaacctggacagcagcgtgaaggagaaccagaagagaacccagagaagactgcagctgcagaaggacatgggcggcctgatcaacttcgagaagagaagaagagagttcgaggtgatcgcccagatcaagctgctgcagagcgcctgcaacagctactgcatgacccccgaccagaagttcatccagtggttccagagacagcagctgctgaccgaggaggagagctacgccctgagctgcgagatcgaggccgccgccgacgccagcaccaccagccccaagcccagaaagagcatggtgaagagactgagcctgctgttcctgggcagcgacatgatcaccagccccacccccaccaaggagcagcccaagagcaccgccagcggcagcagcggcgagagcatggacagcgtgagcgtgagcagctgcgagagcaaccacagcgaggccgaggagggcagcatcacccccatggacacccccgacgagccccagaagaagctgagcgagagcagcagcagctgcagcagcatccacagcatggacaccaacagcagcggcatgagcagcctgatcaaccccctgagcagcccccccagctgcaacaacaaccccaagatccacaagagaagcgtgagcgtgaccagcatcaccagcaccgtgctgccccccgtgtacaaccagcagaacgaggacacctgcatcatcagaatcagcgtggaggacaacaacggcaacatgtacaagagcatcatgctgaccagccaggacaagacccccgccgtgatccagagagccatgctgaagcacaacctggacagcgaccccgccgaggagtacgagctggtgcaggtgatcagcgaggacaaggagctggtgatccccgacagcgccaacgtgttctacgccatgaacagccaggtgaacttcgacttcatcctgagaaagaagaacagcatggaggagcaggtgaagctgagaagcagaaccagcctgaccctgcccagaaccgccaagagaggctgctggagcaacagacacagcaagatcaccctgtag

SEQ ID NO: 96268 - DNA, 1173 bp, Artificial Sequence
  Description of Artificial Sequence: Synthetic coding sequence
atgggcagcttcaaggacagaggcgacggcctgcccaacaccatcagcttcagcctggaggaggaggaggagctggagggcggcgagagcgccgagttcacctgcttcagcgaggacctggtggccgagcagctgacctacatggacgcccagctgttcaagaaggtggtgccccaccactgcctgggctgcatctggagcagaagagacaagaaggagaacaagcacctggcccccaccatcagagccaccatcagccagttcaacaccctgaccaagtgcgtggtgagcaccatcctgggcggcaaggagctgaagacccagcagagagccaagatcatcgagaagtggatcaacatcgcccacgagtgcagactgctgaagaacttcagcagcctgagagccatcgtgagcgccctgcagagcaacagcatctacagactgaagaagacctgggccgccgtgcccagagacagaatgctgatgttcgaggagctgagcgacatcttcagcgaccacaacaaccacctgaccagcagagagctgctgatgaaggagggcaccagcaagttcgccaacctggacagcagcgtgaaggagaaccagaagagaacccagagaagactgcagctgcagaaggacatgggcgtgatgcagggcaccgtgccctacctgggcaccttcctgaccgacctgaccatgctggacaccgccctgcaggactacatcgagggcggcctgatcaacttcgagaagagaagaagagagttcgaggtgatcgcccagatcaagctgctgcagagcgcctgcaacagctactgcatgacccccgaccagaagttcatccagtggttccagagacagcagctgctgaccgaggaggagagctacgccctgagctgcgagatcgaggccgccgccgacgccagcaccaccagccccaagcccagaaagagcatggtgaagagactgagcctgctgttcctgggcagcgacatgatcaccagccccacccccaccaaggagcagcccaagagcaccgccagcggcagcagcggcgagagcatggacagcgtgagcgtgagcagctgcgagagcaaccacagcgaggccgaggagggcagcatcacccccatggacacccccgacgagccccagaagaaggccctgtag

SEQ ID NO: 96269 - DNA, 1422 bp, Artificial Sequence
  Description of Artificial Sequence: Synthetic coding sequence
atgagaaagctgctgaccaacctgcccgccgccgccgtgctgagcgcccaggtgtacagcgccgtgctgcagggcctgtgggaggagaacgtgtgcggcacccccggcagaaccagagtgtgcaccgccctgctgtacggccaggtgtgccccttccaggacagcaccgacggcctgagaaccatcaccagcatcctgttcaactggccccccgagaacaccagcgtgtactaccagcccccccagagaagcagcttcagaatcaagctggccttcagaaacctgagctggcccggcctgggcctggaggaccaccaggagatcgtgctgggccagctggtgctgcccgagcccaacgaggccaagcccgacgaccccgcccccagacccggccagcacgccctgaccatgcccgccctggagcccgccccccccctgctggccgacctgggccccgccctggagcccgagagccccgccgccctgggcccccccggctacctgcacagcgcccccggccccgcccccgcccccggcgagggccccccccccggcaccgtgctggagccccagagcgcccccgagagcagctgcccctgcagaggcagcgtgaagaaccagcccagcgaggagctgcccgacatgaccaccttcccccccagactgctggccgagcagctgaccctgatggacgccgagctgttcaagaaggtggtgctgcacgagtgcctgggctgcatctggggccagggccacctgaagggcaacgagcacatggcccccaccgtgagagccaccatcgcccacttcaacagactgaccaactgcatcaccaccagctgcctgggcgaccacagcatgagagccagagacagagccagagtggtggagcactggatcaaggtggccagagagtgcctgagcctgaacaacttcagcagcgtgcacgtgatcgtgagcgccctgtgcagcaaccccatcggccagctgcacaagacctgggccggcgtgagcagcaagagcatgaaggagctgaaggagctgtgcaagaaggacaccgccgtgaagagagacctgctgatcaaggccggcagcttcaaggtggccacccaggagagaaacccccagagagtgcagatgagactgagaagacagaagaagggcgtggtgcccttcctgggcgacttcctgaccgagctgcagagactggacagcgccatccccgacgacctggacggcaacaccaacaagagaagcaaggaggtgagagtgctgcaggagatgcagctgctgcaggtggccgccatgaactacagactgagacccctggagaagttcgtgacctacttcaccagaatggagcagctgagcgacaaggagagctacaagctgagctgccagctggagcccgagaacccctag

SEQ ID NO: 96270 - DNA, 1743 bp, Artificial Sequence
  Description of Artificial Sequence: Synthetic coding sequence
atgagaaagctgctgaccaacctgcccgccgccgccgtgctgagcgcccaggtgtacagcgccgtgctgcagggcctgtgggaggagaacgtgtgcggcacccccggcagaaccagagtgtgcaccgccctgctgtacggccaggtgtgccccttccaggacagcaccgacggcctgagaaccatcaccagcatcctgttcaactggccccccgagaacaccagcgtgtactaccagcccccccagagaagcagcttcagaatcaagctggccttcagaaacctgagctggcccggcctgggcctggaggaccaccaggagatcgtgctgggccagctggtgctgcccgagcccaacgaggccaagcccgacgaccccgcccccagacccggccagcacgccctgaccatgcccgccctggagcccgccccccccctgctggccgacctgggccccgccctggagcccgagagccccgccgccctgggcccccccggctacctgcacagcgcccccggccccgcccccgcccccggcgagggccccccccccggcaccgtgctggagccccagagcgcccccgagagcagctgcccctgcagaggcagcgtgaagaaccagcccagcgaggagctgcccgacatgaccaccttcccccccagactgctggccgagcagctgaccctgatggacgccgagctgttcaagaaggtggtgctgcacgagtgcctgggctgcatctggggccagggccacctgaagggcaacgagcacatggcccccaccgtgagagccaccatcgcccacttcaacagactgaccaactgcatcaccaccagctgcctgggcgaccacagcatgagagccagagacagagccagagtggtggagcactggatcaaggtggccagagagtgcctgagcctgaacaacttcagcagcgtgcacgtgatcgtgagcgccctgtgcagcaaccccatcggccagctgcacaagacctgggccggcgtgagcagcaagagcatgaaggagctgaaggagctgtgcaagaaggacaccgccgtgaagagagacctgctgatcaaggccggcagcttcaaggtggccacccaggagagaaacccccagagagtgcagatgagactgagaagacagaagaagggcgtggtgcccttcctgggcgacttcctgaccgagctgcagagactggacagcgccatccccgacgacctggacggcaacaccaacaagagaagcaaggaggtgagagtgctgcaggagatgcagctgctgcaggtggccgccatgaactacagactgagacccctggagaagttcgtgacctacttcaccagaatggagcagctgagcgacaaggagagatggggcttcaccatgatgagcagaatcgtgagcaacagctggccccaggccatccaccccccccagccccccaaggtgctgaccctgcagctgcaggccgtgctgcccgccggcgccagaaagcccgtgggctggcagcaccccgccgtggccggcaacccccccggctgctggcccgagcacagactgtgcaccatcccccaccccgacagaagacaccagggcaccaccagcagaagactggccgcccagctgcacctggccctggacccccaccaccagctgctgctgctggccagaatcagaccctgggacttctgcgagagcggcggcagacccttctacgtgtacttcctgtag

SEQ ID NO: 96271 - DNA, 1968 bp, Artificial Sequence
  Description of Artificial Sequence: Synthetic coding sequence
atgaccgagtgcttcctgccccccaccagcagccccagcgagcacagaagagtggagcacggcagcggcctgaccagaacccccagcagcgaggagatcagccccaccaagttccccggcctgtacagaaccggcgagcccagccccccccacgacatcctgcacgagccccccgacgtggtgagcgacgacgagaaggaccacggcaagaagaagggcaagttcaagaagaaggagaagagaaccgagggctacgccgccttccaggaggacagcagcggcgacgaggccgagagccccagcaagatgaagagaagcaagggcatccacgtgttcaagaagcccagcttcagcaagaagaaggagaaggacttcaagatcaaggagaagcccaaggaggagaagcacaaggaggagaagcacaaggaggagaagcacaaggagaagaagagcaaggacctgaccgccgccgacgtggtgaagcagtggaaggagaagaagaagaagaagaagcccatccaggagcccgaggtgccccagatcgacgtgcccaacctgaagcccatcttcggcatccccctggccgacgccgtggagagaaccatgatgtacgacggcatcagactgcccgccgtgttcagagagtgcatcgactacgtggagaagtacggcatgaagtgcgagggcatctacagagtgagcggcatcaagagcaaggtggacgagctgaaggccgcctacgacagagaggagagcaccaacctggaggactacgagcccaacaccgtggccagcctgctgaagcagtacctgagagacctgcccgagaacctgctgaccaaggagctgatgcccagattcgaggaggcctgcggcagaaccaccgagaccgagaaggtgcaggagttccagagactgctgaaggagctgcccgagtgcaactacctgctgatcagctggctgatcgtgcacatggaccacgtgatcgccaaggagctggagaccaagatgaacatccagaacatcagcatcgtgctgagccccaccgtgcagatcagcaacagagtgctgtacgtgttcttcacccacgtgcaggagctgttcggcaacgtggtgctgaagcaggtgatgaagcccctgagatggagcaacatggccaccatgcccaccctgcccgagacccaggccggcatcaaggaggagatcagaagacaggagttcctgctgaactgcctgcacagagacctgcagggcggcatcaaggacctgagcaaggaggagagactgtgggaggtgcagagaatcctgaccgccctgaagagaaagctgagagaggccaagagacaggagtgcgagaccaagatcgcccaggagatcgccagcctgagcaaggaggacgtgagcaaggaggagatgaacgagaacgaggaggtgatcaacatcctgctggcccaggagaacgagatcctgaccgagcaggaggagctgctggccatggagcagttcctgagaagacagatcgccagcgagaaggaggagatcgagagactgagagccgagatcgccgagatccagagcagacagcagcacggcagaagcgagaccgaggagtacagcagcgagagcgagagcgagagcgaggacgaggaggagctgcagatcatcctggaggacctgcagagacagaacgaggagctggagatcaagaacaaccacctgaaccaggccatccacgaggagagagaggccatcatcgagctgagagtgcagctgagactgctgcagatgcagagagccaaggccgagcagcaggcccaggaggacgaggagcccgagtggagaggcggcgccgtgcagccccccagagacggcgtgctggagcccaaggccgccaaggagcagcccaaggccggcaaggagcccgccaagcccagccccagcagagacagaaaggagaccagcatctag

SEQ ID NO: 96272 - DNA, 1968 bp, Artificial Sequence; identical to SEQ ID NO: 96271
  Description of Artificial Sequence: Synthetic coding sequence

SEQ ID NO: 96273 - DNA, 1044 bp, Artificial Sequence
  Description of Artificial Sequence: Synthetic coding sequence
atgaccgagtgcttcctgccccccaccagcagccccagcgagcacagaagagtggagcacggcagcggcctgaccagaacccccagcagcgaggagatcagccccaccaagttccccggcctgtacagaaccggcgagcccagccccccccacgacatcctgcacgagccccccgacgtggtgagcgacgacgagaaggaccacggcaagaagaagggcaagttcaagaagaaggagaagagaaccgagggctacgccgccttccaggaggacagcagcggcgacgaggccgagagccccagcaagatgaagagaagcaagggcatccacgtgttcaagaagcccagcttcagcaagaagaaggagaaggacttcaagatcaaggagaagcccaaggaggagaagcacaaggaggagaagcacaaggaggagaagcacaaggagaagaagagcaaggacctgaccgccgccgacgtggtgaagcagtggaaggagaagaagaagaagaagaagcccatccaggagcccgaggtgccccagatcgacgtgcccaacctgaagcccatcttcggcatccccctggccgacgccgtggagagaaccatgatgtacgacggcatcagactgcccgccgtgttcagagagtgcatcgactacgtggagaagtacggcatgaagtgcgagggcatctacagagtgagcggcatcaagagcaaggtggacgagctgaaggccgcctacgacagagaggagagcaccaacctggaggactacgagcccaacaccgtggccagcctgctgaagcagtacctgagagacctgcccgagaacctgctgaccaaggagctgatgcccagattcgaggaggcctgcggcagaaccaccgagaccgagaaggtgcagagcagcggcgaggaggccgccagaagctgccagttcctgaccgccggcaccagcaagggcctgctgaccggcctggtgaagggcagccacctgggcctggtgcacccccagagaatgctgttcaagcccgagatcttctag

SEQ ID NO: 96274 - DNA, 1980 bp, Artificial Sequence
  Description of Artificial Sequence: Synthetic coding sequence
atggaggccgccgccgccgccgccgccgccgccgccgccgccgccgccgccggcggcggctgcggcagcggccccccccccctgctgctgagcgagggcgagcagcagtgctacagcgagctgttcgccagatgcgccggcgccgccggcggcggccccggcagcggcccccccgaggccgccagagtggcccccggcaccgccaccgccgccgccggccccgtggccgacctgttcagagccagccagctgcccgccgagaccctgcaccagatcaccgagctgtgcggcgccaagagagtgggctacttcggccccacccagttctacatcgccctgaagctgatcgccgccgcccagagcggcctgcccgtgagaatcgagagcatcaagtgcgagctgcccctgcccagattcatgatgagcaagaacgacggcgagatcagattcggcaaccccgccgagctgcacggcaccaaggtgcagatcccctacctgaccaccgagaagaacagcttcaagagaatggacgacgaggacaagcaggagacccagagccccaccatgagccccctggccagcccccccagcagccccccccactaccagagagtgcccctgagccacggctacagcaagctgagaagcagcgccgagcagatgcaccccgccccctacgaggccagacagcccctggtgcagcccgagggcagcagcagcggcggccccggcaccaagcccctgagacaccaggccagcctgatcagaagcttcagcgtggagagagagctgcaggacaacagcagctaccccgacgagccctggagaatcaccgaggagcagagagagtactacgtgaaccagttcagaagcctgcagcccgaccccagcagcttcatcagcggcagcgtggccaagaacttcttcaccaagagcaagctgagcatccccgagctgagctacatctgggagctgagcgacgccgactgcgacggcgccctgaccctgcccgagttctgcgccgccttccacctgatcgtggccagaaagaacggctaccccctgcccgagggcctgccccccaccctgcagcccgagtacctgcaggccgccttccccaagcccaagtgggactgccagctgttcgacagctacagcgagagcctgcccgccaaccagcagcccagagacctgaacagaatggagaagaccagcgtgaaggacatggccgacctgcccgtgcccaaccaggacgtgaccagcgacgacaagcaggccctgaagagcaccatcaacgaggccctgcccaaggacgtgagcgaggaccccgccacccccaaggacagcaacagcctgaaggccagacccagaagcagaagctacagcagcaccagcatcgaggaggccatgaagagaggcgaggacccccccacccccccccccagaccccagaagacccacagcagagccagcagcctggacctgaacaaggtgttccagcccagcgtgcccgccaccaagagcggcctgctgccccccccccccgccctgccccccagaccctgccccagccagagcgagcaggtgagcgaggccgagctgctgccccagctgagcagagcccccagccaggccgccgagagcagccccgccaagaaggacgtgctgtacagccagccccccagcaagcccatcagaagaaagttcagacccgagaaccaggccaccgagaaccaggagcccagcaccgccgccagcggccccgccagcgccgccaccatgaagccccaccccaccgtgcagaagcagagcagcaagcagaagaaggccatccagaccgccatcagaaagaacaaggaggccaacgccgtgctggccagactgaacagcgagctgcagcagcagctgaaggaggtgcaccaggagagaatcgccctggagaaccagctggagcagctgagacccgtgaccgtgctgtag

SEQ ID NO: 96275 - DNA, 1983 bp, Artificial Sequence
  Description of Artificial Sequence: Synthetic coding sequence
atggaggccgccgccgccgccgccgccgccgccgccgccgccgccgccgccggcggcggctgcggcagcggccccccccccctgctgctgagcgagggcgagcagcagtgctacagcgagctgttcgccagatgcgccggcgccgccggcggcggccccggcagcggcccccccgaggccgccagagtggcccccggcaccgccaccgccgccgccggccccgtggccgacctgttcagagccagccagctgcccgccgagaccctgcaccagatcaccgagctgtgcggcgccaagagagtgggctacttcggccccacccagttctacatcgccctgaagctgatcgccgccgcccagagcggcctgcccgtgagaatcgagagcatcaagtgcgagctgcccctgcccagattcatgatgagcaagaacgacggcgagatcagattcggcaaccccgccgagctgcacggcaccaaggtgcagatcccctacctgaccaccgagaagaacagcttcaagagaatggacgacgaggacaagcagcaggagacccagagccccaccatgagccccctggccagcccccccagcagccccccccactaccagagagtgcccctgagccacggctacagcaagctgagaagcagcgccgagcagatgcaccccgccccctacgaggccagacagcccctggtgcagcccgagggcagcagcagcggcggccccggcaccaagcccctgagacaccaggccagcctgatcagaagcttcagcgtggagagagagctgcaggacaacagcagctaccccgacgagccctggagaatcaccgaggagcagagagagtactacgtgaaccagttcagaagcctgcagcccgaccccagcagcttcatcagcggcagcgtggccaagaacttcttcaccaagagcaagctgagcatccccgagctgagctacatctgggagctgagcgacgccgactgcgacggcgccctgaccctgcccgagttctgcgccgccttccacctgatcgtggccagaaagaacggctaccccctgcccgagggcctgccccccaccctgcagcccgagtacctgcaggccgccttccccaagcccaagtgggactgccagctgttcgacagctacagcgagagcctgcccgccaaccagcagcccagagacctgaacagaatggagaagaccagcgtgaaggacatggccgacctgcccgtgcccaaccaggacgtgaccagcgacgacaagcaggccctgaagagcaccatcaacgaggccctgcccaaggacgtgagcgaggaccccgccacccccaaggacagcaacagcctgaaggccagacccagaagcagaagctacagcagcaccagcatcgaggaggccatgaagagaggcgaggacccccccacccccccccccagaccccagaagacccacagcagagccagcagcctggacctgaacaaggtgttccagcccagcgtgcccgccaccaagagcggcctgctgccccccccccccgccctgccccccagaccctgccccagccagagcgagcaggtgagcgaggccgagctgctgccccagctgagcagagcccccagccaggccgccgagagcagccccgccaagaaggacgtgctgtacagccagccccccagcaagcccatcagaagaaagttcagacccgagaaccaggccaccgagaaccaggagcccagcaccgccgccagcggccccgccagcgccgccaccatgaagccccaccccaccgtgcagaagcagagcagcaagcagaagaaggccatccagaccgccatcagaaagaacaaggaggccaacgccgtgctggccagactgaacagcgagctgcagcagcagctgaaggaggtgcaccaggagagaatcgccctggagaaccagctggagcagctgagacccgtgaccgtgctgtag

SEQ ID NO: 96276 - DNA, 1824 bp, Artificial Sequence
  Description of Artificial Sequence: Synthetic coding sequence
atggaggccgccgccgccgccgccgccgccgccgccgccgccgccgccgccggcggcggctgcggcagcggccccccccccctgctgctgagcgagggcgagcagcagtgctacagcgagctgttcgccagatgcgccggcgccgccggcggcggccccggcagcggcccccccgaggccgccagagtggcccccggcaccgccaccgccgccgccggccccgtggccgacctgttcagagccagccagctgcccgccgagaccctgcaccagatcaccgagctgtgcggcgccaagagagtgggctacttcggccccacccagttctacatcgccctgaagctgatcgccgccgcccagagcggcctgcccgtgagaatcgagagcatcaagtgcgagctgcccctgcccagattcatgatgagcaagaacgacggcgagatcagattcggcaaccccgccgagctgcacggcaccaaggtgcagatcccctacctgaccaccgagaagaacagcttcaagagaatggacgacgaggacaagcagcaggagacccagagccccaccatgagccccctggccagcccccccagcagccccccccactaccagagagtgcccctgagccacggctacagcaagctgagaagcagcgccgagcagatgcaccccgccccctacgaggccagacagcccctggtgcagcccgagggcagcagcagcggcggccccggcaccaagcccctgagacaccaggccagcctgatcagaagcttcagcgtggagagagagctgcaggacaacagcagctaccccgacgagccctggagaatcaccgaggagcagagagagtactacgtgaaccagttcagaagcctgcagcccgaccccagcagcttcatcagcggcagcgtggccaagaacttcttcaccaagagcaagctgagcatccccgagctgagctacatctgggagctgagcgacgccgactgcgacggcgccctgaccctgcccgagttctgcgccgccttccacctgatcgtggccagaaagaacggctaccccctgcccgagggcctgccccccaccctgcagcccgagtacctgcaggccgccttccccaagcccaagtgggactgccagctgttcgacagctacagcgagagcctgcccgccaaccagcagcccagagacctgaacagaatggagaagaccagcgtgaaggacatggccgacctgcccgtgcccaaccaggacgtgaccagcgacgacaagcaggccctgaagagcaccatcaacgaggccctgcccaaggacgtgagcgaggaccccgccacccccaaggacagcaacagcctgaaggccagacccagaagcagaagctacagcagcaccagcatcgaggaggccatgaagagaggcgaggacccccccacccccccccccagaccccagaagacccacagcagagccagcagcctggacctgaacaaggtgttccagcccagcgtgcccgccaccaagagcggcctgctgccccccccccccgccctgccccccagaccctgccccagccagagcgagcaggtgagcgaggccgagctgctgccccagctgagcagagcccccagccaggccgccgagagcagccccgccaagaaggacgtgctgtacagccagccccccagcaagcccatcagaagaaagttcagacccgtgtgcggcatccagcccctgatcagcatcgagctgagagccttcagaaccagcagacacctgttcaacgtgagcctggtgcactggcaggccctgagcatcgcctag

SEQ ID NO: 96277 - DNA, 1380 bp, Artificial Sequence
  Description of Artificial Sequence: Synthetic coding sequence
atgatgagcaagaacgacggcgagatcagattcggcaaccccgccgagctgcacggcaccaaggtgcagatcccctacctgaccaccgagaagaacagcttcaagagaatggacgacgaggacaagcaggagacccagagccccaccatgagccccctggccagcccccccagcagccccccccactaccagagagtgcccctgagccacggctacagcaagctgagaagcagcgccgagcagatgcaccccgccccctacgaggccagacagcccctggtgcagcccgagggcagcagcagcggcggccccggcaccaagcccctgagacaccaggccagcctgatcagaagcttcagcgtggagagagagctgcaggacaacagcagctaccccgacgagccctggagaatcaccgaggagcagagagagtactacgtgaaccagttcagaagcctgcagcccgaccccagcagcttcatcagcggcagcgtggccaagaacttcttcaccaagagcaagctgagcatccccgagctgagctacatctgggagctgagcgacgccgactgcgacggcgccctgaccctgcccgagttctgcgccgccttccacctgatcgtggccagaaagaacggctaccccctgcccgagggcctgccccccaccctgcagcccgagtacctgcaggccgccttccccaagcccaagtgggactgccagctgttcgacagctacagcgagagcctgcccgccaaccagcagcccagagacctgaacagaatggagaagaccagcgtgaaggacatggccgacctgcccgtgcccaaccaggacgtgaccagcgacgacaagcaggccctgaagagcaccatcaacgaggccctgcccaaggacgtgagcgaggaccccgccaccaagagcggcctgctgccccccccccccgccctgccccccagaccctgccccagccagagcgagcaggtgagcgaggccgagctgctgccccagctgagcagagcccccagccaggccgccgagagcagccccgccaagaaggacgtgctgtacagccagccccccagcaagcccatcagaagaaagttcagacccgagaaccaggccaccgagaaccaggagcccagcaccgccgccagcggccccgccagcgccgccaccatgaagccccaccccaccgtgcagaagcagagcagcaagcagaagaaggccatccagaccgccatcagaaagaacaaggaggccaacgccgtgctggccagactgaacagcgagctgcagcagcagctgaaggaggtgcaccaggagagaatcgccctggagaaccagctggagcagctgagacccgtgaccgtgctgtag

SEQ ID NO: 96278 - DNA, 1863 bp, Artificial Sequence
  Description of Artificial Sequence: Synthetic coding sequence
atggccgccgccaccgccgaccccggcgccggcaacccccagcccggcgacagcagcggcggcggcgccggcggcggcctgcccagccccggcgagcaggagctgagcagaagactgcagagactgtaccccgccgtgaaccagcaggagacccccctgcccagaagctggagccccaaggacaagtacaactacatcggcctgagccagggcaacctgagagtgcactacaagggccacggcaagaaccacaaggacgccgccagcgtgagagccacccaccccatccccgccgcctgcggcatctactacttcgaggtgaagatcgtgagcaagggcagagacggctacatgggcatcggcctgagcgcccagggcgtgaacatgaacagactgcccggctgggacaagcacagctacggctaccacggcgacgacggccacagcttctgcagcagcggcaccggccagccctacggccccaccttcaccaccggcgacgtgatcggctgctgcgtgaacctgatcaacggcacctgcttctacaccaagaacggccacagcctgggcatcgccttcaccgacctgcccgccaacctgtaccccaccgtgggcctgcagacccccggcgagatcgtggacgccaacttcggccagcagcccttcctgttcgacatcgaggactacatgagagagtggagagccaaggtgcagggcaccgtgcactgcttccccatcagcgccagactgggcgagtggcaggccgtgctgcagaacatggtgagcagctacctggtgcaccacggctactgcgccaccgccaccgccttcgccagaatgaccgagacccccatccaggaggagcaggccagcatcaagaacagacagaagatccagaagctggtgctggagggcagagtgggcgaggccatcgagaccacccagagattctaccccggcctgctggagcacaaccccaacctgctgttcatgctgaagtgcagacagttcgtggagatggtgaacggcaccgacagcgaggtgagaagcctgagcagcagaagccccaagagccaggacagctaccccggcagccccagcctgagccccagacacggccccagcagcagccacatgcacaacaccggcgccgacagccccagctgcagcaacggcgtggccagcaccaagagcaagcagaaccacagcaagtaccccgcccccagcagcagcagcagcagcagcagcagcagcagcagcagcagccccagcagcgtgaactacagcgagagcaacagcaccgacagcaccaagagccagcaccacagcagcaccagcaaccaggagaccagcgacagcgagatggagatggaggccgagcactaccccaacggcgtgctgggcagcatgagcaccagaatcgtgaacggcgcctacaagcacgaggacctgcagaccgacgagagcagcatggacgacagacaccccagaagacagctgtgcggcggcaaccaggccgccaccgagagaatcatcctgttcggcagagagctgcaggccctgagcgagcagctgggcagagagtacggcaagaacctggcccacaccgagatgctgcaggacgccttcagcctgctggcctacagcgacccctggagctgccccgtgggccagcagctggaccccatccagagagagcccgtgtgcgccgccctgaacagcgccatcctggagagccagaacctgcccaagcagccccccctgatgctggccctgggccaggccagcgagtgcctgagactgatggccagagccggcctgggcagctgcagcttcgccagagtggacgactacctgcactag

SEQ ID NO: 96279 - DNA, 1602 bp, Artificial Sequence
  Description of Artificial Sequence: Synthetic coding sequence
atgggcatcggcctgagcgcccagggcgtgaacatgaacagactgcccggctgggacaagcacagctacggctaccacggcgacgacggccacagcttctgcagcagcggcaccggccagccctacggccccaccttcaccaccggcgacgtgatcggctgctgcgtgaacctgatcaacggcacctgcttctacaccaagaacggccacagcctgggcatcgccttcaccgacctgcccgccaacctgtaccccaccgtgggcctgcagacccccggcgagatcgtggacgccaacttcggccagcagcccttcctgttcgacatcgaggactacatgagagagtggagagccaaggtgcagggcaccgtgcactgcttccccatcagcgccagactgggcgagtggcaggccgtgctgcagaacatggtgagcagctacctggtgcaccacggctactgcgccaccgccaccgccttcgccagaatgaccgagacccccatccaggaggagcaggccagcatcaagaacagacagaagatccagaagctggtgctggagggcagagtgggcgaggccatcgagaccacccagagattctaccccggcctgctggagcacaaccccaacctgctgttcatgctgaagtgcagacagttcgtggagatggtgaacggcaccgacagcgaggtgagaagcctgagcagcagaagccccaagagccaggacagctaccccggcagccccagcctgagccccagacacggccccagcagcagccacatgcacaacaccggcgccgacagccccagctgcagcaacggcgtggccagcaccaagagcaagcagaaccacagcaagtaccccgcccccagcagcagcagcagcagcagcagcagcagcagcagcagcagccccagcagcgtgaactacagcgagagcaacagcaccgacagcaccaagagccagcaccacagcagcaccagcaaccaggagaccagcaacccctggctgcagctggagagaagacccaaccaggccgcccccaccaccccccccggccccacccccaccagcacccccccccacagcgacagcgagatggagatggaggccgagcactaccccaacggcgtgctgggcagcatgagcaccagaatcgtgaacggcgcctacaagcacgaggacctgcagaccgacgagagcagcatggacgacagacaccccagaagacagctgtgcggcggcaaccaggccgccaccgagagaatcatcctgttcggcagagagctgcaggccctgagcgagcagctgggcagagagtacggcaagaacctggcccacaccgagatgctgcaggacgccttcagcctgctggcctacagcgacccctggagctgccccgtgggccagcagctggaccccatccagagagagcccgtgtgcgccgccctgaacagcgccatcctggagagccagaacctgcccaagcagccccccctgatgctggccctgggccaggccagcgagtgcctgagactgatggccagagccggcctgggcagctgcagcttcgccagagtggacgactacctgcactag

SEQ ID NO: 96280 - DNA, 540 bp, Artificial Sequence
  Description of Artificial Sequence: Synthetic coding sequence
atgggctgggacaagcacagctacggctaccacggcgacgacggccacagcttctgcagcagcggcaccggccagccctacggccccaccttcaccaccggcgacgtgatcggctgctgcgtgaacctgatcaacggcacctgcttctacaccaagaacggccacagcctgggcatcgccttcaccgacctgcccgccaacctgtaccccaccgtgggcctgcagacccccggcgagatcgtggacgccaacttcggccagcagcccttcctgttcgacatcgaggactacatgagagagtggagagccaaggtgcagggcaccgtgcactgcttccccatcagcgccagactgggcgagtggcaggccgtgctgcagaacatggtgagcagctacctggtgcaccacggctactgcgccaccgccaccgccttcgccagaatgaccgagacccccatccaggaggagcaggccagcatcaagaacagacagagcaaggtgtacagcaccttccccttccccttcctgacctgcccctag

SEQ ID NO: 96281 - DNA, 1785 bp, Artificial Sequence
  Description of Artificial Sequence: Synthetic coding sequence
atggccgccgccaccgccgaccccggcgccggcaacccccagcccggcgacagcagcggcggcggcgccggcggcggcctgcccagccccggcgagcaggagctgagcagaagactgcagagactgtaccccgccgtgaaccagcaggagacccccctgcccagaagctggagccccaaggacaagtacaactacatcggcctgagccagggcaacctgagagtgcactacaagggccacggcaagaaccacaaggacgccgccagcgtgagagccacccaccccatccccgccgcctgcggcatctactacttcgaggtgaagatcgtgagcaagggcagagacggctacatgggcatcggcctgagcgcccagggcgtgaacatgaacagactgcccggcatcgccttcaccgacctgcccgccaacctgtaccccaccgtgggcctgcagacccccggcgagatcgtggacgccaacttcggccagcagcccttcctgttcgacatcgaggactacatgagagagtggagagccaaggtgcagggcaccgtgcactgcttccccatcagcgccagactgggcgagtggcaggccgtgctgcagaacatggtgagcagctacctggtgcaccacggctactgcgccaccgccaccgccttcgccagaatgaccgagacccccatccaggaggagcaggccagcatcaagaacagacagaagatccagaagctggtgctggagggcagagtgggcgaggccatcgagaccacccagagattctaccccggcctgctggagcacaaccccaacctgctgttcatgctgaagtgcagacagttcgtggagatggtgaacggcaccgacagcgaggtgagaagcctgagcagcagaagccccaagagccaggacagctaccccggcagccccagcctgagccccagacacggccccagcagcagccacatgcacaacaccggcgccgacagccccagctgcagcaacggcgtggccagcaccaagagcaagcagaaccacagcaagtaccccgcccccagcagcagcagcagcagcagcagcagcagcagcagcagcagccccagcagcgtgaactacagcgagagcaacagcaccgacagcaccaagagccagcaccacagcagcaccagcaaccaggagaccagcaacccctggctgcagctggagagaagacccaaccaggccgcccccaccaccccccccggccccacccccaccagcacccccccccacagcgacagcgagatggagatggaggccgagcactaccccaacggcgtgctgggcagcatgagcaccagaatcgtgaacggcgcctacaagcacgaggacctgcagaccgacgagagcagcatggacgacagacaccccagaagacagctgtgcggcggcaaccaggccgccaccgagagaatcatcctgttcggcagagagctgcaggccctgagcgagcagctgggcagagagtacggcaagaacctggcccacaccgagatgctgcaggacgccttcagcctgctggcctacagcgacccctggagctgccccgtgggccagcagctggaccccatccagagagagcccgtgtgcgccgccctgaacagcgccatcctggagagccagaacctgcccaagcagccccccctgatgctggccctgggccaggccagcgagtgcctgagactgatggccagagccggcctgggcagctgcagcttcgccagagtggacgactacctgcactag

SEQ ID NO: 96282 - DNA, 1176 bp, Artificial Sequence
  Description of Artificial Sequence: Synthetic coding sequence
atgagagagtggagagccaaggtgcagggcaccgtgcactgcttccccatcagcgccagactgggcgagtggcaggccgtgctgcagaacatggtgagcagctacctggtgcaccacggctactgcgccaccgccaccgccttcgccagaatgaccgagacccccatccaggaggagcaggccagcatcaagaacagacagaagatccagaagctggtgctggagggcagagtgggcgaggccatcgagaccacccagagattctaccccggcctgctggagcacaaccccaacctgctgttcatgctgaagtgcagacagttcgtggagatggtgaacggcaccgacagcgaggtgagaagcctgagcagcagaagccccaagagccaggacagctaccccggcagccccagcctgagccccagacacggccccagcagcagccacatgcacaacaccggcgccgacagccccagctgcagcaacggcgtggccagcaccaagagcaagcagaaccacagcaagtaccccgcccccagcagcagcagcagcagcagcagcagcagcagcagcagcagccccagcagcgtgaactacagcgagagcaacagcaccgacagcaccaagagccagcaccacagcagcaccagcaaccaggagaccagcgacagcgagatggagatggaggccgagcactaccccaacggcgtgctgggcagcatgagcaccagaatcgtgaacggcgcctacaagcacgaggacctgcagaccgacgagagcagcatggacgacagacaccccagaagacagctgtgcggcggcaaccaggccgccaccgagagaatcatcctgttcggcagagagctgcaggccctgagcgagcagctgggcagagagtacggcaagaacctggcccacaccgagatgctgcaggacgccttcagcctgctggcctacagcgacccctggagctgccccgtgggccagcagctggaccccatccagagagagcccgtgtgcgccgccctgaacagcgccatcctggagagccagaacctgcccaagcagccccccctgatgctggccctgggccaggccagcgagtgcctgagactgatggccagagccggcctgggcagctgcagcttcgccagagtggacgactacctgcactag

SEQ ID NO: 96283 - DNA, 3267 bp, Artificial Sequence
  Description of Artificial Sequence: Synthetic coding sequence
atggccctgcacttccagagcctggccgagctggaggtgctgtgcacccacctgtacatcggcaccgacctgacccagagaatcgaggccgagaaggccctgctggagctgatcgacagccccgagtgcctgagcaagtgccagctgctgctggagcagggcaccaccagctacgcccagctgctggccgccacctgcctgagcaagctggtgagcagagtgagccccctgcccgtggagcagagaatggacatcagaaactacatcctgaactacgtggccagccagcccaagctggcccccttcgtgatccaggccctgatccaggtgatcgccaagatcaccaagctgggctggttcgaggtgcagaaggaccagttcgtgttcagagagatcatcgccgacgtgaagaagttcctgcagggcaccgtggagcactgcatcatcggcgtgatcatcctgagcgagctgacccaggagatgaacctggtggactacagcagacccagcgccaagcacagaaagatcgccaccagcttcagagacaccagcctgaaggacgtgctggtgctggcctgcagcctgctgaaggaggtgttcgccaagcccctgaacctgcaggaccagtgccagcagaacctggtgatgcaggtgctgaagctggtgctgaactgcctgaacttcgacttcatcggcagcagcgccgacgagagcgccgacgacctgtgcaccgtgcagatccccaccacctggagaaccatcttcctggagcccgagaccctggacctgttcttcaacctgtaccacagcctgccccccctgctgagccagctggccctgagctgcctggtgcagttcgccagcaccagaagaagcctgttcaacagccccgagagagccaagtacctgggcaacctgatcaagggcgtgaagagaatcctggagaacccccagggcctgagcgaccccggcaactaccacgagttctgcagattcctggccagactgaagaccaactaccagctgggcgagctggtgatggtgaaggagtaccccgaggtgatcagactgatcgccaacttcaccatcaccagcctgcagcactgggagttcgcccccaacagcgtgcactacctgctgaccctgtggcagagaatggtggccagcgtgcccttcgtgaagagcaccgagccccacctgctggacacctacgcccccgagatcaccaaggccttcatcaccagcagactggacagcgtggccatcgtggtgagagaccacctggacgaccccctggacgacaccgccaccgtgttccagcagctggagcagctgtgcaccgtgagcagatgcgagtacgagaagacctgcgccctgctggtgcagctgttcgaccagaacgcccagaactaccagaagctgctgcacccctacagcggcgtgaccgtggacatcaccatccaggagggcagactggcctggctggtgtacctggtgggcaccgtggtgggcggcagactgacctacaccagcaccgacgagcacgacgccatggacggcgagctgagctgcagagtgttccagctgatcagcctgatggacaccggcctgcccagatgctgcaacgagaagatcgagctggccatcctgtggttcctggaccagttcagaaagacctacgtgggcgaccagctgcagagaaccagcaaggtgtacgccagaatgagcgaggtgctgggcatcaccgacgacaaccacgtgctggagaccttcatgaccaagatcgtgaccaacctgaagtactggggcagatacgagcccgtgatcagcagaaccctgcagttcctgaacgacctgagcgtgggctacatcctgctgaagaagctggtgaagatcgacgccgtgaagttcatgctgaagaaccacaccagcgagcacttccccttcctgggcatcagcgacaaccacagcctgagcgacttcagatgcagaaccaccttctacaccgccctgaccagactgctgatggtggacctgggcgaggacgaggacgagttcgagaacttcatgctgcccctgaccgtggccttcgagaccgtgctgcagatcttcaacaacaacttcaagcaggaggacgtgaagagaatgctgatcggcctggccagagacctgagaggcatcgccttcgccctgaacaccaagaccagctacaccatgctgttcgactggatgtaccccacctacctgcccctgctgcagaacgccgtggagagatggtacggcgagcccacctgcaccacccccatcctgaagctgatggccgagctgatgcagaacagaagccagagactgaacttcgacgtgagcagccccaacggcatcctgctgttcagagaggccagcaagatggtgtgcacctacggcaaccagatcctgagcctgggcagcctgagcaaggaccagatctaccccatgaagctgaagggcatcagcatctgctacagcgccctgaagagcgccctgtgcggcaactacgtgagcttcggcgtgttcaagctgtacggcgacaaccacttcgacaacgtgctgcaggccttcgtgaagatgctgctgagcgtgagccacagcgacctgctgcagtacagaaagctgagccagagctactaccccctgctggagtgcctgacccaggaccacatgagcttcatcatcaacctggagccccccgtgctgatgtacgtgctgaccagcatcagcgagggcctgaccaccctggacaccgtggtgagcagcagctgctgcaccagcctggactacatcgtgacctacctgttcaagcacatcgccaaggagggcaagaagcccctgagatgcagagaggccacccaggccggccagagactgctgcacttcatgcagcagaaccccgacgtgctgcagcagatgatgagcgtgctgatgaacaccatcgtgttcgaggactgcagaaaccagtggagcgtgagcagacccctgctgggcctgatcctgctgaacgagaagtacttcagcgagctgagagccagcctgatcaacagccagcccctgcccaagcaggaggtgctggcccagtgcttcagaaacctgatggagggcgtggagcagaacctgagcgtgaagaacagagacagattcacccagaacctgagcgtgttcagaagagacgtggccgaggccctgagaagcgacggcaacaccgagccctgcagcctggacatgatgagctag

SEQ ID NO: 96284 - DNA, 1557 bp, Artificial Sequence
  Description of Artificial Sequence: Synthetic coding sequence
gtgtacgccagaatgagcgaggtgctgggcatcaccgacgacaaccacgtgctggagaccttcatgaccaagatcgtgaccaacctgaagtactggggcagatacgagcccgtgatcagcagaaccctgcagttcctgaacgacctgagcgtgggctacatcctgctgaagaagctggtgaagatcgacgccgtgaagttcatgctgaagaaccacaccagcgagcacttccccttcctgggcatcagcgacaaccacagcctgagcgacttcagatgcagaaccaccttctacaccgccctgaccagactgctgatggtggacctgggcgaggacgaggacgagttcgagaacttcatgctgcccctgaccgtggccttcgagaccgtgctgcagatcttcaacaacaacttcaagcaggaggacgtgaagagaatgctgatcggcctggccagagacctgagaggcatcgccttcgccctgaacaccaagaccagctacaccatgctgttcgactggatgtaccccacctacctgcccctgctgcagaacgccgtggagagatggtacggcgagcccacctgcaccacccccatcctgaagctgatggccgagctgatgcagaacagaagccagagactgaacttcgacgtgagcagccccaacggcatcctgctgttcagagaggccagcaagatggtgtgcacctacggcaaccagatcctgagcctgggcagcctgagcaaggaccagatctaccccatgaagctgaagggcatcagcatctgctacagcgccctgaagagcgccctgtgcggcaactacgtgagcttcggcgtgttcaagctgtacggcgacaaccacttcgacaacgtgctgcaggccttcgtgaagatgctgctgagcgtgagccacagcgacctgctgcagtacagaaagctgagccagagctactaccccctgctggagtgcctgacccaggaccacatgagcttcatcatcaacctggagccccccgtgctgatgtacgtgctgaccagcatcagcgagggcctgaccaccctggacaccgtggtgagcagcagctgctgcaccagcctggactacatcgtgacctacctgttcaagcacatcgccaaggagggcaagaagcccctgagatgcagagaggccacccaggccggccagagactgctgcacttcatgcagcagaaccccgacgtgctgcagcagatgatgagcgtgctgatgaacaccatcgtgttcgaggactgcagaaaccagtggagcgtgagcagacccctgctgggcctgatcctgctgaacgagaagtacttcagcgagctgagagccagcctgatcaacagccagcccctgcccaagcaggaggtgctggcccagtgcttcagaaacctgatggagggcgtggagcagaacctgagcgtgaagaacagagacagattcacccagaacctgagcgtgttcagaagagacgtggccgaggccctgagaagcgacggcaacaccgagccctgcagcctggacatgatgagctag

SEQ ID NO: 96285 - DNA, 1419 bp, Artificial Sequence
  Description of Artificial Sequence: Synthetic coding sequence
atggacatcagaaactacatcctgaactacgtggccagccagcccaagctggcccccttcgtgatccaggccctgatccaggtgatcgccaagatcaccaagctgggctggttcgaggtgcagaaggaccagttcgtgttcagagagatcatcgccgacgtgaagaagttcctgcaggtggactacagcagacccagcgccaagcacagaaagatcgccaccagcttcagagacaccagcctgaaggacgtgctggtgctggcctgcagcctgctgaaggaggtgttcgccaagcccctgaacctgcaggaccagtgccagcagaacctggtgatgcaggtgctgaagctggtgctgaactgcctgaacttcgacttcatcggcagcagcgccgacgagagcgccgacgacctgtgcaccgtgcagatccccaccacctggagaaccatcttcctggagcccgagaccctggacctgttcttcaacctgtaccacagcctgccccccctgctgagccagctggccctgagctgcctggtgcagttcgccagcaccagaagaagcctgttcaacagccccgagagagccaagtacctgggcaacctgatcaagggcgtgaagagaatcctggagaacccccagggcctgagcgaccccggcaactaccacgagttctgcagattcctggccagactgaagaccaactaccagctgggcgagctggtgatggtgaaggagtaccccgaggtgatcagactgatcgccaacttcaccatcaccagcctgcagcactgggagttcgcccccaacagcgtgcactacctgctgaccctgtggcagagaatggtggccagcgtgcccttcgtgaagagcaccgagccccacctgctggacacctacgcccccgagatcaccaaggccttcatcaccagcagactggacagcgtggccatcgtggtgagagaccacctggacgaccccctggacgacaccgccaccgtgttccagcagctggagcagctgtgcaccgtgagcagatgcgagtacgagaagacctgcgccctgctggtgcagctgttcgaccagaacgcccagaactaccagaagctgctgcacccctacagcggcgtgaccgtggacatcaccatccaggagggcagactggcctggctggtgtacctggtgggcaccgtggtgggcggcagactgacctacaccagcaccgacgagcacgacgccatggacggcgagctgagctgcagagtgttccagctgatcagcctgatggacaccggcctgcccagatgctgcaacgagaagatcgagctggccatcctgtggttcctggaccagttcagaaagacctacgtgggcgaccagctgcagagaaccagcaagaagaccttcatctacctgtag

SEQ ID NO: 96286 - DNA, 9675 bp, Artificial Sequence
  Description of Artificial Sequence: Synthetic coding sequence
atgagaagaagcaaggccgacgtggagagatacatcgccagcgtgcagggcagcacccccagccccagacagaagagcatgaagggcttctacttcgccaagctgtactacgaggccaaggagtacgacctggccaagaagtacatctgcacctacatcaacgtgcaggagagagaccccaaggcccacagattcctgggcctgctgtacgagctggaggagaacaccgacaaggccgtggagtgctacagaagaagcgtggagctgaaccccacccagaaggacctggtgctgaagatcgccgagctgctgtgcaagaacgacgtgaccgacggcagagccaagtactggctggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggaggtgtacagaagcaccaagagactgaaggacgccgtggcccactgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctgcagagcttcgacagcgccctgcagagcgtgaagagcctgggcggcaacgacgagctgagcgccaccttcctggagatgaagggccacttctacatgcacgccggcagcctgctgctgaagatgggccagcacagcagcaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggagatcgtggagaccttcgccaacaagagcggccagagcgccctgtacgacgccctgttcagcagccagagccccaaggacaccagcttcctgggcagcgacgacatcggcaacatcgacgtgagagagcccgagctggaggacctgaccagatacgacgtgggcgccatcagagcccacaacggcagcctgcagcacctgacctggctgggcctgcagtggaacagcctgcccgccctgcccggcatcagaaagtggctgaagcagctgttccaccacctgccccacgagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacgtggccaagctgagactgctggtgcagcacgagatcaacaccctgagagcccaggagaagcacggcctgcagcccgccctgctggtgcactgggccgagtgcctgcagaagaccggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacatcaccttcgccatcctggacgccgtgaacggcaacatcgaggacgccgtgaccgccttcgagagcatcaagagcgtggtgagctactggaacctggccctgatcttccacagaaaggccgaggacatcgagaacgacgccctgagccccgaggagcaggaggagtgcaagaactacctgagaaagaccagagactacctgatcaagatcatcgacgacagcgacagcaacctgagcgtggtgaagaagctgcccgtgcccctggagagcgtgaaggagatgctgaacagcgtgatgcaggagctggaggactacagcgagggcggccccctgtacaagaacggcagcctgagaaacgccgacagcgagatcaagcacagcacccccagccccaccagatacagcctgagccccagcaagagctacaagtacagccccaagaccccccccagatgggccgaggaccagaacagcctgctgaagatgatctgccagcaggtggaggccatcaagaaggagatgcaggagctgaagctgaacagcagcaacagcgccagcccccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggccccgtgtacggcatgaacagactgcccccccagcagcacatctacgcctacccccagcagatgcacaccccccccgtgcagagcagcagcgcctgcatgttcagccaggagatgtacggcccccccgccctgagattcgagagccccgccaccggcatcctgagccccagaggcgacgactacttcaactacaacgtgcagcagaccagcaccaacccccccctgcccgagcccggctacttcaccaagccccccatcgccgcccacgccagcagaagcgccgagagcaagaccatcgagttcggcaagaccaacttcgtgcagcccatgcccggcgagggcctgagacccagcctgcccacccaggcccacaccacccagcccacccccttcaagttcaacagcaacttcaagagcaacgacggcgacttcaccttcagcagcccccaggtggtgacccagcccccccccgccgcctacagcaacagcgagagcctgctgggcctgctgaccagcgacaagcccctgcagggcgacggctacagcggcgccaagcccatccccggcggccagaccatcggccccagaaacaccttcaacttcggcagcaagaacgtgagcggcatcagcttcaccgagaacatgggcagcagccagcagaagaacagcggcttcagaagaagcgacgacatgttcaccttccacggccccggcaagagcgtgttcggcacccccaccctggagaccgccaacaagaaccacgagaccgacggcggcagcgcccacggcgacgacgacgacgacggcccccacttcgagcccgtggtgcccctgcccgacaagatcgaggtgaagaccggcgaggaggacgaggaggagttcttctgcaacagagccaagctgttcagattcgacgtggagagcaaggagtggaaggagagaggcatcggcaacgtgaagatcctgagacacaagaccagcggcaagatcagactgctgatgagaagagagcaggtgctgaagatctgcgccaaccactacatcagccccgacatgaagctgacccccaacgccggcagcgacagaagcttcgtgtggcacgccctggactacgccgacgagctgcccaagcccgagcagctggccatcagattcaagacccccgaggaggccgccctgttcaagtgcaagttcgaggaggcccagagcatcctgaaggcccccggcaccaacgtggccatggccagcaaccaggccgtgagaatcgtgaaggagcccaccagccacgacaacaaggacatctgcaagagcgacgccggcaacctgaacttcgagttccaggtggccaagaaggagggcagctggtggcactgcaacagctgcagcctgaagaacgccagcaccgccaagaagtgcgtgagctgccagaacctgaaccccagcaacaaggagctggtgggcccccccctggccgagaccgtgttcacccccaagaccagccccgagaacgtgcaggacagattcgccctggtgacccccaagaaggagggccactgggactgcagcatctgcctggtgagaaacgagcccaccgtgagcagatgcatcgcctgccagaacaccaagagcgccaacaagagcggcagcagcttcgtgcaccaggccagcttcaagttcggccagggcgacctgcccaagcccatcaacagcgacttcagaagcgtgttcagcaccaaggagggccagtgggactgcagcgcctgcctggtgcagaacgagggcagcagcaccaagtgcgccgcctgccagaaccccagaaagcagagcctgcccgccaccagcatccccacccccgccagcttcaagttcggcaccagcgagaccagcaagaccctgaagagcggcttcgaggacatgttcgccaagaaggagggccagtgggactgcagcagctgcctggtgagaaacgaggccaacgccaccagatgcgtggcctgccagaaccccgacaagcccagccccagcaccagcgtgcccgcccccgccagcttcaagttcggcaccagcgagaccagcaaggcccccaagagcggcttcgagggcatgttcaccaagaaggagggccagtgggactgcagcgtgtgcctggtgagaaacgaggccagcgccaccaagtgcatcgcctgccagaaccccggcaagcagaaccagaccaccagcgccgtgagcacccccgccagcagcgagaccagcaaggcccccaagagcggcttcgagggcatgttcaccaagaaggagggccagtgggactgcagcgtgtgcctggtgagaaacgaggccagcgccaccaagtgcatcgcctgccagaaccccggcaagcagaaccagaccaccagcgccgtgagcacccccgccagcagcgagaccagcaaggcccccaagagcggcttcgagggcatgttcaccaagaaggagggccagtgggactgcagcgtgtgcctggtgagaaacgaggccagcgccaccaagtgcatcgcctgccagtgccccagcaagcagaaccagaccaccgccatcagcacccccgccagcagcgagatcagcaaggcccccaagagcggcttcgagggcatgttcatcagaaagggccagtgggactgcagcgtgtgctgcgtgcagaacgagagcagcagcctgaagtgcgtggcctgcgacgccagcaagcccacccacaagcccatcgccgaggcccccagcgccttcaccctgggcagcgagatgaagctgcacgacagcagcggcagccaggtgggcaccggcttcaagagcaacttcagcgagaaggccagcaagttcggcaacaccgagcagggcttcaagttcggccacgtggaccaggagaacagccccagcttcatgttccagggcagcagcaacaccgagttcaagagcaccaaggagggcttcagcatccccgtgagcgccgacggcttcaagttcggcatcagcgagcccggcaaccaggagaagaagagcgagaagcccctggagaacggcaccggcttccaggcccaggacatcagcggccagaagaacggcagaggcgtgatcttcggccagaccagcagcaccttcaccttcgccgacctggccaagagcaccagcggcgagggcttccagttcggcaagaaggaccccaacttcaagggcttcagcggcgccggcgagaagctgttcagcagccagtacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggaggacgagaaggtgctgtacagccagagagtgaagctgttcagattcgacgccgaggtgagccagtggaaggagagaggcctgggcaacctgaagatcctgaagaacgaggtgaacggcaagctgagaatgctgatgagaagagagcaggtgctgaaggtgtgcgccaaccactggatcaccaccaccatgaacctgaagcccctgagcggcagcgacagagcctggatgtggctggccagcgacttcagcgacggcgacgccaagctggagcagctggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacagcgtgagcagcagcagcgtgcacgccagccccctggccagcagccccgtgagaaagaacctgttcagattcggcgagagcaccaccggcttcaacttcagcttcaagagcgccctgagccccagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccaagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgaccctgcagaacatgaagggcaccgagagagtgtggctgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccaccagcgaggtggaggtgagcagcaccagcgagaccacccccaaggccgtggtgagcccccccaagttcgtgttcggcagcgagagcgtgaagagcatcttcagcagcgagaagagcaagcccttcgccttcggcaacagcagcgccaccggcagcctgttcggcttcagcttcaacgcccccctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgttcgccagcttccccaccgaggagagcagcatcaactacaccttcaagacccccgagaaggccaaggagaagaagaagcccgaggacagccccagcgacgacgacgtgctgatcgtgtacgagctgacccccaccgccgagcagaaggccctggccaccaagctgaagctgccccccaccttcttctgctacaagaacagacccgactacgtgagcgaggaggaggaggacgacgaggacttcgagaccgccgtgaagaagctgaacggcaagctgtacctggacggcagcgagaagtgcagacccctggaggagaacaccgccgacaacgagaaggagtgcatcatcgtgtgggagaagaagcccaccgtggaggagaaggccaaggccgacaccctgaagctgccccccaccttcttctgcggcgtgtgcagcgacaccgacgaggacaacggcaacggcgaggacttccagagcgagctgcagaaggtgcaggaggcccagaagagccagaccgaggagatcaccagcaccaccgacagcgtgtacaccggcggcaccgaggtgatggtgcccagcttctgcaagagcgaggagcccgacagcatcaccaagagcatcagcagccccagcgtgagcagcgagaccatggacaagcccgtggacctgagcaccagaaaggagatcgacaccgacagcaccagccagggcgagagcaagatcgtgagcttcggcttcggcagcagcaccggcctgagcttcgccgacctggccagcagcaacagcggcgacttcgccttcggcagcaaggacaagaacttccagtgggccaacaccggcgccgccgtgttcggcacccagagcgtgggcacccagagcgccggcaaggtgggcgaggacgaggacggcagcgacgaggaggtggtgcacaacgaggacatccacttcgagcccatcgtgagcctgcccgaggtggaggtgaagagcggcgaggaggacgaggagatcctgttcaaggagagagccaagctgtacagatgggacagagacgtgagccagtggaaggagagaggcgtgggcgacatcaagatcctgtggcacaccatgaagaactactacagaatcctgatgagaagagaccaggtgttcaaggtgtgcgccaaccacgtgatcaccaagaccatggagctgaagcccctgaacgtgagcaacaacgccctggtgtggaccgccagcgactacgccgacggcgaggccaaggtggagcagctggccgtgagattcaagaccaaggaggtggccgactgcttcaagaagaccttcgaggagtgccagcagaacctgatgaagctgcagaagggccacgtgagcctggccgccgagctgagcaaggagaccaaccccgtggtgttcttcgacgtgtgcgccgacggcgagcccctgggcagaatcaccatggagctgttcagcaacatcgtgcccagaaccgccgagaacttcagagccctgtgcaccggcgagaagggcttcggcttcaagaacagcatcttccacagagtgatccccgacttcgtgtgccagggcggcgacatcaccaagcacgacggcaccggcggccagagcatctacggcgacaagttcgaggacgagaacttcgacgtgaagcacaccggccccggcctgctgagcatggccaaccagggccagaacaccaacaacagccagttcgtgatcaccctgaagaaggccgagcacctggacttcaagcacgtggtgttcggcttcgtgaaggacggcatggacaccgtgaagaagatcgagagcttcggcagccccaagggcagcgtgtgcagaagaatcaccatcaccgagtgcggccagatctag

SEQ ID NO: 96287 - DNA, 1500 bp, Artificial Sequence
  Description of Artificial Sequence: Synthetic coding sequence
atggccgacctggccaacgaggagaagcccgccatcgccccccccgtgttcgtgttccagaaggacaagggccagaagagaagcgccggcggcagcagccccgagggcggcgaggacagcgacagagaggacggcaactactgcccccccgtgaagagagagagaaccagcagcctgacccagttcccccccagccagagcgaggagagaagcagcggcttcagactgaagccccccaccctgatccacggccaggcccccagcgccggcctgcccagccagaagcccaaggagcagcagagaagcgtgctgagacccgccgtgctgcaggccccccagcccaaggccctgagccagaccgtgcccagcagcggcaccaacggcgtgagcctgcccgccgactgcaccggcgccgtgcccgccgccagccccgacaccgccgcctggagaagccccagcgaggccgccgacgaggtgtgcgccctggaggagaaggagccccagaagaacgagagcagcaacgccagcgaggaggaggcctgcgagaagaaggaccccgccacccagcaggccttcgtgttcggccagaacctgagagacagagtgaagctgatcaacgagagcgtggacgaggccgacatggagaacgccggccaccccagcgccgacacccccaccgccaccaactacttcctgcagtacatcagcagcagcctggagaacagcaccaacagcgccgacgccagcagcaacaagttcgtgttcggccagaacatgagcgagagagtgctgagcccccccaagctgaacgaggtgagcagcgacgccaacagagagaacgccgccgccgagagcggcagcgagagcagcagccaggaggccacccccgagaaggagagcctggccgagagcgccgccgcctacaccaaggccaccgccagaaagtgcctgctggagaaggtggaggtgatcaccggcgaggaggccgagagcaacgtgctgcagatgcagtgcaagctgttcgtgttcgacaagaccagccagagctgggtggagagaggcagaggcctgctgagactgaacgacatggccagcaccgacgacggcaccctgcagagcagactggtgatgagaacccagggcagcctgagactgatcctgaacaccaagctgtgggcccagatgcagatcgacaaggccagcgagaagagcatcagaatcaccgccatggacaccgaggaccagggcgtgaaggtgttcctgatcagcgccagcagcaaggacaccggccagctgtacgccgccctgcaccacagaatcctggccctgagaagcagagtggagcaggagcaggaggccaagatgcccgcccccgagcccggcgccgcccccagcaacgaggaggacgacagcgacgacgacgacgtgctggcccccagcggcgccaccgccgccggcgccggcgacgagggcgacggccagaccaccggcagcacctag

SEQ ID NO: 96288 - DNA, 1194 bp, Artificial Sequence
  Description of Artificial Sequence: Synthetic coding sequence
gccgacgtgaccaaggccgagaagcccgccatcgccccccccgtgttcgtgttccagaaggacaagggccagaagagaagcgccggcggcagcagccccgagggcggcgaggacagcgacagagaggacggcaactactgcccccccgtgaagagagagagaaccagcagcctgacccagttcccccccagccagagcgaggagagaagcagcggcttcagactgaagccccccaccctgatccacggccaggcccccagcgccggcctgcccagccagaagcccaaggagcagcagagaagcgtgctgagacccgccgtgctgcaggccccccagcccaaggccctgagccagaccgtgcccagcagcggcaccaacggcgtgagcctgcccgccgactgcaccggcgccgtgcccgccgccagccccgacaccgccgcctggagaagccccagcgaggccgccgacgaggtgtgcgccctggaggagaaggagccccagaagaacgagagcagcaacgccagcgaggaggaggcctgcgagaagaaggaccccgccacccagcaggccttcgtgttcggccagaacctgagagacagagtgaagctgatcaacgagagcgtggacgaggccgacatggagaacgccggccaccccagcgccgacacccccaccgccaccaactacttcctgcagtacatcagcagcagcctggagaacagcaccaacagcgccgacgccagcagcaacaagttcgtgttcggccagaacatgagcgagagagtgctgagcccccccaagctgaacgaggtgagcagcgacgccaacagagagaacgccgccgccgagagcggcagcgagagcagcagccaggaggccacccccgagaaggagagcctggccgagagcgccgccgcctacaccaaggccaccgccagaaagtgcctgctggagaaggtggaggtgatcaccggcgaggaggccgagagcaacgtgctgcagatgcagtgcaagctgttcgtgttcgacaagaccagccagagctggtggctgctgagacacccccaccccagccaccccgccgtgggcccctgcctgtgcggcgagcagcccgccctgtgcccctgccccggcctgcccaactacagacccggcacccccgcccagctgggcggcctgctggtgagagtgtag

SEQ ID NO: 96289 - DNA, 1704 bp, Artificial Sequence
  Description of Artificial Sequence: Synthetic coding sequence
atggccgacctggccaacgaggagaagcccgccatcgccccccccgtgttcgtgttccagaaggacaagggccagaagagccccgccgagcagaagaacctgagcgacagcggcgaggagcccagaggcgaggccgaggccccccaccacggcaccggccaccccgagagcgccggcgagcacgccctggagccccccgcccccgccggcgccagcgccagcaccccccccccccccgcccccgaggcccagctgccccccttccccagagagctggccggcagaagcgccggcggcagcagccccgagggcggcgaggacagcgacagagaggacggcaactactgcccccccgtgaagagagagagaaccagcagcctgacccagttcccccccagccagagcgaggagagaagcagcggcttcagactgaagccccccaccctgatccacggccaggcccccagcgccggcctgcccagccagaagcccaaggagcagcagagaagcgtgctgagacccgccgtgctgcaggccccccagcccaaggccctgagccagaccgtgcccagcagcggcaccaacggcgtgagcctgcccgccgactgcaccggcgccgtgcccgccgccagccccgacaccgccgcctggagaagccccagcgaggccgccgacgaggtgtgcgccctggaggagaaggagccccagaagaacgagagcagcaacgccagcgaggaggaggcctgcgagaagaaggaccccgccacccagcaggccttcgtgttcggccagaacctgagagacagagtgaagctgatcaacgagagcgtggacgaggccgacatggagaacgccggccaccccagcgccgacacccccaccgccaccaactacttcctgcagtacatcagcagcagcctggagaacagcaccaacagcgccgacgccagcagcaacaagttcgtgttcggccagaacatgagcgagagagtgctgagcccccccaagctgaacgaggtgagcagcgacgccaacagagagaacgccgccgccgagagcggcagcgagagcagcagccaggaggccacccccgagaaggagagcctggccgagagcgccgccgcctacaccaaggccaccgccagaaagtgcctgctggagaaggtggaggtgatcaccggcgaggaggccgagagcaacgtgctgcagatgcagtgcaagctgttcgtgttcgacaagaccagccagagctgggtggagagaggcagaggcctgctgagactgaacgacatggccagcaccgacgacggcaccctgcagagcagactggtgatgagaacccagggcagcctgagactgatcctgaacaccaagctgtgggcccagatgcagatcgacaaggccagcgagaagagcatcagaatcaccgccatggacaccgaggaccagggcgtgaaggtgttcctgatcagcgccagcagcaaggacaccggccagctgtacgccgccctgcaccacagaatcctggccctgagaagcagagtggagcaggagcaggaggccaagatgcccgcccccgagcccggcgccgcccccagcaacgaggaggacgacagcgacgacgacgacgtgctggcccccagcggcgccaccgccgccggcgccggcgacgagggcgacggccagaccaccggcagcacctag

SEQ ID NO: 96290 - DNA, 1689 bp, Artificial Sequence
  Description of Artificial Sequence: Synthetic coding sequence
atggccgacctggccaacgaggagaagcccgccatcgccccccccgtgttcgtgttccagaaggacaagggccagaagagccccgccgagcagaagaacctgagcgacagcggcgaggagcccagaggcgaggccgaggccccccaccacggcaccggccaccccgagagcgccggcgagcacgccctggagccccccgcccccgccggcgccagcgccagcaccccccccccccccgcccccgaggcccagctgccccccttccccagagagctggccggcagaagcgccggcggcagcagccccgagggcggcgaggacagcgacagagaggacggcaactactgcccccccgtgaagagagagagaaccagcagcctgacccagttcccccccagccagagcgaggagagaagcagcggcttcagactgaagccccccaccctgatccacggccaggcccccagcgccggcctgcccagccagaagcccaaggagcagcagagaagcgtgctgagacccgccgtgctgcaggccccccagcccaaggccctgagccagaccgtgcccagcagcggcaccaacggcgtgagcctgcccgccgactgcaccggcgccgtgcccgccgccagccccgacaccgccgcctggagaagccccagcgaggccgccgacgaggagaaggagccccagaagaacgagagcagcaacgccagcgaggaggaggcctgcgagaagaaggaccccgccacccagcaggccttcgtgttcggccagaacctgagagacagagtgaagctgatcaacgagagcgtggacgaggccgacatggagaacgccggccaccccagcgccgacacccccaccgccaccaactacttcctgcagtacatcagcagcagcctggagaacagcaccaacagcgccgacgccagcagcaacaagttcgtgttcggccagaacatgagcgagagagtgctgagcccccccaagctgaacgaggtgagcagcgacgccaacagagagaacgccgccgccgagagcggcagcgagagcagcagccaggaggccacccccgagaaggagagcctggccgagagcgccgccgcctacaccaaggccaccgccagaaagtgcctgctggagaaggtggaggtgatcaccggcgaggaggccgagagcaacgtgctgcagatgcagtgcaagctgttcgtgttcgacaagaccagccagagctgggtggagagaggcagaggcctgctgagactgaacgacatggccagcaccgacgacggcaccctgcagagcagactggtgatgagaacccagggcagcctgagactgatcctgaacaccaagctgtgggcccagatgcagatcgacaaggccagcgagaagagcatcagaatcaccgccatggacaccgaggaccagggcgtgaaggtgttcctgatcagcgccagcagcaaggacaccggccagctgtacgccgccctgcaccacagaatcctggccctgagaagcagagtggagcaggagcaggaggccaagatgcccgcccccgagcccggcgccgcccccagcaacgaggaggacgacagcgacgacgacgacgtgctggcccccagcggcgccaccgccgccggcgccggcgacgagggcgacggccagaccaccggcagcacctag

SEQ ID NO: 96291 - DNA, 1320 bp, Artificial Sequence
  Description of Artificial Sequence: Synthetic coding sequence
atggccgacctggccaacgaggaggagagaagcagcggcttcagactgaagccccccaccctgatccacggccaggcccccagcgccggcctgcccagccagaagcccaaggagcagcagagaagcgtgctgagacccgccgtgctgcaggccccccagcccaaggccctgagccagaccgtgcccagcagcggcaccaacggcgtgagcctgcccgccgactgcaccggcgccgtgcccgccgccagccccgacaccgccgcctggagaagccccagcgaggccgccgacgaggtgtgcgccctggaggagaaggagccccagaagaacgagagcagcaacgccagcgaggaggaggcctgcgagaagaaggaccccgccacccagcaggccttcgtgttcggccagaacctgagagacagagtgaagctgatcaacgagagcgtggacgaggccgacatggagaacgccggccaccccagcgccgacacccccaccgccaccaactacttcctgcagtacatcagcagcagcctggagaacagcaccaacagcgccgacgccagcagcaacaagttcgtgttcggccagaacatgagcgagagagtgctgagcccccccaagctgaacgaggtgagcagcgacgccaacagagagaacgccgccgccgagagcggcagcgagagcagcagccaggaggccacccccgagaaggagagcctggccgagagcgccgccgcctacaccaaggccaccgccagaaagtgcctgctggagaaggtggaggtgatcaccggcgaggaggccgagagcaacgtgctgcagatgcagtgcaagctgttcgtgttcgacaagaccagccagagctgggtggagagaggcagaggcctgctgagactgaacgacatggccagcaccgacgacggcaccctgcagagcagactggtgatgagaacccagggcagcctgagactgatcctgaacaccaagctgtgggcccagatgcagatcgacaaggccagcgagaagagcatcagaatcaccgccatggacaccgaggaccagggcgtgaaggtgttcctgatcagcgccagcagcaaggacaccggccagctgtacgccgccctgcaccacagaatcctggccctgagaagcagagtggagcaggagcaggaggccaagatgcccgcccccgagcccggcgccgcccccagcaacgaggaggacgacagcgacgacgacgacgtgctggcccccagcggcgccaccgccgccggcgccggcgacgagggcgacggccagaccaccggcagcacctag

SEQ ID NO: 96292 - DNA, 2190 bp, Artificial Sequence
  Description of Artificial Sequence: Synthetic coding sequence
atgagcggccagcccccccccccccccccccagcagcagcagcagcagcagcagctgagcccccccccccccgccgccctggcccccgtgagcggcgtggtgctgcccgccccccccgccgtgagcgccggcagcagccccgccggcagccccggcggcggcgccggcggcgagggcctgggcgccgccgccgccgccctgctgctgcaccccccccccccccccccccccgccaccgccgcccccccccccccccccccccccccccccccccccgccagcgccgccgcccccgccagcggcccccccgccccccccggcctggccgccggccccggccccgccggcggcgcccccacccccgccctggtggccggcagcagcgccgccgcccccttcccccacggcgacagcgccctgaacgagcaggagaaggagctgcagagaagactgaagagactgtaccccgccgtggacgagcaggagacccccctgcccagaagctggagccccaaggacaagttcagctacatcggcctgagccagaacaacctgagagtgcactacaagggccacggcaagacccccaaggacgccgccagcgtgagagccacccaccccatccccgccgcctgcggcatctactacttcgaggtgaagatcgtgagcaagggcagagacggctacatgggcatcggcctgagcgcccagggcgtgaacatgaacagactgcccggctgggacaagcacagctacggctaccacggcgacgacggccacagcttctgcagcagcggcaccggccagccctacggccccaccttcaccaccggcgacgtgatcggctgctgcgtgaacctgatcaacaacacctgcttctacaccaagaacggccacagcctgggcatcgccttcaccgacctgccccccaacctgtaccccaccgtgggcctgcagacccccggcgaggtggtggacgccaacttcggccagcaccccttcgtgttcgacatcgaggactacatgagagagtggagaaccaagatccaggcccagatcgacagattccccatcggcgacagagagggcgagtggcagaccatgatccagaagatggtgagcagctacctggtgcaccacggctactgcgccaccgccgaggccttcgccagaagcaccgaccagaccgtgctggaggagctggccagcatcaagaacagacagagaatccagaagctggtgctggccggcagaatgggcgaggccatcgagaccacccagcagctgtaccccagcctgctggagagaaaccccaacctgctgttcaccctgaaggtgagacagttcatcgagatggtgaacggcaccgacagcgaggtgagatgcctgggcggcagaagccccaagagccaggacagctaccccgtgagccccagacccttcagcagccccagcatgagccccagccacggcatgaacatccacaacctggccagcggcaagggcagcaccgcccacttcagcggcttcgagagctgcagcaacggcgtgatcagcaacaaggcccaccagagctactgccacagcaacaagcaccagagcagcaacctgaacgtgcccgagctgaacagcatcaacatgagcagaagccagcaggtgaacaacttcaccagcaacgacgtggacatggagaccgaccactacagcaacggcgtgggcgagaccagcagcaacggcttcctgaacggcagcagcaagcacgaccacgagatggaggactgcgacaccgagatggaggtggacagcagccagctgagaagacagctgtgcggcggcagccaggccgccatcgagagaatgatccacttcggcagagagctgcaggccatgagcgagcagctgagaagagactgcggcaagaacaccgccaacaagaagatgctgaaggacgccttcagcctgctggcctacagcgacccctggaacagccccgtgggcaaccagctggaccccatccagagagagcccgtgtgcagcgccctgaacagcgccatcctggagacccacaacctgcccaagcagccccccctggccctggccatgggccaggccacccagtgcctgggcctgatggccagaagcggcatcggcagctgcgccttcgccaccgtggaggactacctgcactag

SEQ ID NO: 96293 - DNA, 1176 bp, Artificial Sequence
  Description of Artificial Sequence: Synthetic coding sequence
atgagcggccagcccccccccccccccccccagcagcagcagcagcagcagcagctgagcccccccccccccgccgccctggcccccgtgagcggcgtggtgctgcccgccccccccgccgtgagcgccggcagcagccccgccggcagccccggcggcggcgccggcggcgagggcctgggcgccgccgccgccgccctgctgctgcaccccccccccccccccccccccgccaccgccgcccccccccccccccccccccccccccccccccccgccagcgccgccgcccccgccagcggcccccccgccccccccggcctggccgccggccccggccccgccggcggcgcccccacccccgccctggtggccggcagcagcgccgccgcccccttcccccacggcgacagcgccctgaacgagcaggagaaggagctgcagagaagactgaagagactgtaccccgccgtggacgagcaggagacccccctgcccagaagctggagccccaaggacaagttcagctacatcggcctgagccagaacaacctgagagtgcactacaagggccacggcaagacccccaaggacgccgccagcgtgagagccacccaccccatccccgccgcctgcggcatctactacttcgaggtgaagatcgtgagcaagggcagagacggctacatgggcatcggcctgagcgcccagggcgtgaacatgaacagactgcccggctgggacaagcacagctacggctaccacggcgacgacggccacagcttctgcagcagcggcaccggccagccctacggccccaccttcaccaccggcgacgtgatcggctgctgcgtgaacctgatcaacaacacctgcttctacaccaagaacggccacagcctgggcatcgccttcaccgacctgccccccctggactaccccgtgagccccagacccttcagcagccccagcatgagccccagccacggcatgaacatccacaacctggccagcggcaagggcagcaccgcccacttcagcggcttcgagagctgcagcaacggcgtgatcagcaacaaggcccaccagagctactgccacagcaacaagcaccagagcagcaacgagtgcaccagaaccaagcagtacaagtacgtgaagatcaccgccagctag

SEQ ID NO: 96294 - DNA, 1503 bp, Artificial Sequence
  Description of Artificial Sequence: Synthetic coding sequence
atgggcatcggcctgagcgcccagggcgtgaacatgaacagactgcccggctgggacaagcacagctacggctaccacggcgacgacggccacagcttctgcagcagcggcaccggccagccctacggccccaccttcaccaccggcgacgtgatcggctgctgcgtgaacctgatcaacaacacctgcttctacaccaagaacggccacagcctgggcatcgccttcaccgacctgccccccaacctgtaccccaccgtgggcctgcagacccccggcgaggtggtggacgccaacttcggccagcaccccttcgtgttcgacatcgaggactacatgagagagtggagaaccaagatccaggcccagatcgacagattccccatcggcgacagagagggcgagtggcagaccatgatccagaagatggtgagcagctacctggtgcaccacggctactgcgccaccgccgaggccttcgccagaagcaccgaccagaccgtgctggaggagctggccagcatcaagaacagacagagaatccagaagctggtgctggccggcagaatgggcgaggccatcgagaccacccagcagctgtaccccagcctgctggagagaaaccccaacctgctgttcaccctgaaggtgagacagttcatcgagatggtgaacggcaccgacagcgaggtgagatgcctgggcggcagaagccccaagagccaggacagctaccccgtgagccccagacccttcagcagccccagcatgagccccagccacggcatgaacatccacaacctggccagcggcaagggcagcaccgcccacttcagcggcttcgagagctgcagcaacggcgtgatcagcaacaaggcccaccagagctactgccacagcaacaagcaccagagcagcaacctgaacgtgcccgagctgaacagcatcaacatgagcagaagccagcaggtgaacaacttcaccagcaacgacgtggacatggagaccgaccactacagcaacggcgtgggcgagaccagcagcaacggcttcctgaacggcagcagcaagcacgaccacgagatggaggactgcgacaccgagatggaggtggacagcagccagctgagaagacagctgtgcggcggcagccaggccgccatcgagagaatgatccacttcggcagagagctgcaggccatgagcgagcagctgagaagagactgcggcaagaacaccgccaacaagaagatgctgaaggacgccttcagcctgctggcctacagcgacccctggaacagccccgtgggcaaccagctggaccccatccagagagagcccgtgtgcagcgccctgaacagcgccatcctggagacccacaacctgcccaagcagccccccctggccctggccatgggccaggccacccagtgcctgggcctgatggccagaagcggcatcggcagctgcgccttcgccaccgtggaggactacctgcactag

SEQ ID NO: 96295 - DNA, 387 bp, Artificial Sequence
  Description of Artificial Sequence: Synthetic coding sequence
atgttcgacgtgaccagcagagtgacctacaagaacgtgcccaactggcacagagacctggtgagagtgtgcgagaacatccccatcgtgctgtgcggcaacaaggtggacatcaaggacagaaaggtgaaggccaagagcatcgtgttccacagaaagaagaacctgcagtactacgacatcagcgccaagagcaactacaacttcgagaagcccttcctgtggctggccagaaagctgatcggcgaccccaacctggagttcgtggccatgcccgccctggccccccccgaggtggtgatggaccccgccctggccgcccagtacgagcacgacctggaggtggcccagaccaccgccctgcccgacgaggacgacgacctgtag

SEQ ID NO: 96296 - DNA, 702 bp, Artificial Sequence
  Description of Artificial Sequence: Synthetic coding sequence
atggccgcccagggcgagccccaggtgcagttcaagctggtgctggtgggcgacggcggcaccggcaagaccaccttcgtgaagagacacctgaccggcgagttcgagaagaagtacgtggccaccctgggcgtggaggtgcaccccctggtgttccacaccaacagaggccccatcaagttcaacgtgtgggacaccgccggccaggagaagttcggcggcctgagagacggctactacatccaggagatgggcatccaccacgtggcccacgccggcctggagctgatgagcagcgcccagtgcgccatcatcatgttcgacgtgaccagcagagtgacctacaagaacgtgcccaactggcacagagacctggtgagagtgtgcgagaacatccccatcgtgctgtgcggcaacaaggtggacatcaaggacagaaaggtgaaggccaagagcatcgtgttccacagaaagaagaacctgcagtactacgacatcagcgccaagagcaactacaacttcgagaagcccttcctgtggctggccagaaagctgatcggcgaccccaacctggagttcgtggccatgcccgccctggccccccccgaggtggtgatggaccccgccctggccgcccagtacgagcacgacctggaggtggcccagaccaccgccctgcccgacgaggacgacgacctgtag

SEQ ID NO: 96297 - DNA, 651 bp, Artificial Sequence
  Description of Artificial Sequence: Synthetic coding sequence
atggccgcccagggcgagccccaggtgcagttcaagctggtgctggtgggcgacggcggcaccggcaagaccaccttcgtgaagagacacctgaccggcgagttcgagaagaagtacgtggccaccctgggcgtggaggtgcaccccctggtgttccacaccaacagaggccccatcaagttcaacgtgtgggacaccgccggccaggagaagttcggcggcctgagagacggctactacatccaggcccagtgcgccatcatcatgttcgacgtgaccagcagagtgacctacaagaacgtgcccaactggcacagagacctggtgagagtgtgcgagaacatccccatcgtgctgtgcggcaacaaggtggacatcaaggacagaaaggtgaaggccaagagcatcgtgttccacagaaagaagaacctgcagtactacgacatcagcgccaagagcaactacaacttcgagaagcccttcctgtggctggccagaaagctgatcggcgaccccaacctggagttcgtggccatgcccgccctggccccccccgaggtggtgatggaccccgccctggccgcccagtacgagcacgacctggaggtggcccagaccaccgccctgcccgacgaggacgacgacctgtag

SEQ ID NO: 96298 - DNA, 705 bp, Artificial Sequence
  Description of Artificial Sequence: Synthetic coding sequence
agaagaagaagactgagactgagaagactgaactgcgccagcgccatcttccccgccagcgtgggcagagccagaagaagattctggaagctggtgctggtgggcgacggcggcaccggcaagaccaccttcgtgaagagacacctgaccggcgagttcgagaagaagtacgtggccaccctgggcgtggaggtgcaccccctggtgttccacaccaacagaggccccatcaagttcaacgtgtgggacaccgccggccaggagaagttcggcggcctgagagacggctactacatccaggcccagtgcgccatcatcatgttcgacgtgaccagcagagtgacctacaagaacgtgcccaactggcacagagacctggtgagagtgtgcgagaacatccccatcgtgctgtgcggcaacaaggtggacatcaaggacagaaaggtgaaggccaagagcatcgtgttccacagaaagaagaacctgcagtactacgacatcagcgccaagagcaactacaacttcgagaagcccttcctgtggctggccagaaagctgatcggcgaccccaacctggagttcgtggccatgcccgccctggccccccccgaggtggtgatggaccccgccctggccgcccagtacgagcacgacctggaggtggcccagaccaccgccctgcccgacgaggacgacgacctgtag

SEQ ID NO: 96299 - DNA, 387 bp, Artificial Sequence; identical to SEQ ID NO: 96295
  Description of Artificial Sequence: Synthetic coding sequence

SEQ ID NO: 96300 - DNA, 651 bp, Artificial Sequence; identical to SEQ ID NO: 96297
  Description of Artificial Sequence: Synthetic coding sequence

SEQ ID NO: 96301 - DNA, 5271 bp, Artificial Sequence
  Description of Artificial Sequence: Synthetic coding sequence
atgagaagaagcaaggcctacggcgagagatacctggccagcgtgcagggcagcgcccccagccccggcaagaagctgagaggcttctacttcgccaagctgtactacgaggccaaggagtacgacctggccaagaagtacgtgtgcacctacctgagcgtgcaggagagagaccccagagcccacagattcctgggcctgctgtacgagctggaggagaacaccgagaaggccgtggagtgctacagaagaagcctggagctgaaccccccccagaaggacctggtgctgaagatcgccgagctgctgtgcaagaacgacgtgaccgacggcagagccaagtactgggtggagagagccgccaagctgttccccggcagccccgccatctacaagctgaaggagcacctgctggactgcgagggcgaggacggctggaacaagctgttcgactggatccagagcgagctgtacgtgagacccgacgacgtgcacatgaacatcagactggtggagctgtacagaagcaacaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggcaggccctgagcgagctggccgccctgtgctacgtgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggaggtggtggagaccttcgccaacaagagcggccagagcgtgctgtacaacgccctgttcagcagccagagcagcaaggacaccagcttcctgggcagcgacgacatcggcaacatcgacgtgcaggagcccgagctggaggacctggccagatacgacgtgggcgccatccaggcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagagactgtgcaccgagagacagaagagctggtgggacgccgtgtgcaccctgatccacagaaaggccgtgcccggcaacagcgccgagctgagactggtggtgcagcacgagatcaacaccctgagagcccaggagaagcacggcctgcagcccgccctgctggtgcactgggccaagtgcctgcagaagatgggcagaggcctgaacagcagctacgaccagcaggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatcctggacgccgtgcacggcaacatcgaggacgccgtgaccgccttcgagagcatcaagagcgtggtgagctactggaacctggccctgatcttccacagaaaggccgaggacatcgagaacgacgccgtgttccccgaggagcaggaggagtgcaagaactacctgagaaagaccagagactacctgatcaagatcatcgacgacagcgacagcaacctgagcgtggtgaagaagctgcccgtgcccctggagagcgtgaaggagatgctgaagagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgagaaagatgatctgccaggaggtgaaggccatcaccaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatcgccgtgagcgccgacggcttcaagttcggcatcagcgagcccggcaaccaggagaagaagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctgcaagaccgaggacagcgacgacatccacttcgagcccgtggtgcagatgcccgagaaggtggagctggtgaccggcgaggagggcgagaaggtgctgtacagccagggcgtgaagctgttcagattcgacgccgagatcagccagtggaaggagagaggcctgggcaacctgaagatcctgaagaacgaggtgaacggcaagcccagaatgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagagcctgctgcccgtgatcaacaccatgctgcagctgagccccgaggagaagggcaagctggccgccgtggcccagggcctgcaggagaccagcatccccaagaagaagtag

SEQ ID NO: 96302 - DNA, 5247 bp, Artificial Sequence
  Description of Artificial Sequence: Synthetic coding sequence
atgaacgtgatgggcttcaacaccgacagactggcctggaccagaaacaagctgagaggcttctacttcgccaagctgtactacgaggccaaggagtacgacctggccaagaagtacgtgtgcacctacctgagcgtgcaggagagagaccccagagcccacagattcctgggcctgctgtacgagctggaggagaacaccgagaaggccgtggagtgctacagaagaagcctggagctgaaccccccccagaaggacctggtgctgaagatcgccgagctgctgtgcaagaacgacgtgaccgacggcagagccaagtactgggtggagagagccgccaagctgttccccggcagccccgccatctacaagctgaaggagcacctgctggactgcgagggcgaggacggctggaacaagctgttcgactggatccagagcgagctgtacgtgagacccgacgacgtgcacatgaacatcagactggtggagctgtacagaagcaacaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggcaggccctgagcgagctggccgccctgtgctacgtgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggaggtggtggagaccttcgccaacaagagcggccagagcgtgctgtacaacgccctgttcagcagccagagcagcaaggacaccagcttcctgggcagcgacgacatcggcaacatcgacgtgcaggagcccgagctggaggacctggccagatacgacgtgggcgccatccaggcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagagactgtgcaccgagagacagaagagctggtgggacgccgtgtgcaccctgatccacagaaaggccgtgcccggcaacagcgccgagctgagactggtggtgcagcacgagatcaacaccctgagagcccaggagaagcacggcctgcagcccgccctgctggtgcactgggccaagtgcctgcagaagatgggcagaggcctgaacagcagctacgaccagcaggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatcctggacgccgtgcacggcaacatcgaggacgccgtgaccgccttcgagagcatcaagagcgtggtgagctactggaacctggccctgatcttccacagaaaggccgaggacatcgagaacgacgccgtgttccccgaggagcaggaggagtgcaagaactacctgagaaagaccagagactacctgatcaagatcatcgacgacagcgacagcaacctgagcgtggtgaagaagctgcccgtgcccctggagagcgtgaaggagatgctgaagagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgagaaagatgatctgccaggaggtgaaggccatcaccaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatcgccgtgagcgccgacggcttcaagttcggcatcagcgagcccggcaaccaggagaagaagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctgcaagaccgaggacagcgacgacatccacttcgagcccgtggtgcagatgcccgagaaggtggagctggtgaccggcgaggagggcgagaaggtgctgtacagccagggcgtgaagctgttcagattcgacgccgagatcagccagtggaaggagagaggcctgggcaacctgaagatcctgaagaacgaggtgaacggcaagcccagaatgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagagcctgctgcccgtgatcaacaccatgctgcagctgagccccgaggagaagggcaagctggccgccgtggcccagggcctgcaggagaccagcatccccaagaagaagtag

SEQ ID NO: 96303 - DNA, 1935 bp, Artificial Sequence
  Description of Artificial Sequence: Synthetic coding sequence
atgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagcccagcagctgctacaagtacgacgtggccgcccagccctag

SEQ ID NO: 96304 - DNA, 5247 bp, Artificial Sequence; identical to SEQ ID NO: 96302
  Description of Artificial Sequence: Synthetic coding sequence

SEQ ID NO: 96305 - DNA, 3042 bp, Artificial Sequence
  Description of Artificial Sequence: Synthetic coding sequence
atgctgaagagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgagaaagatgatctgccaggaggtgaaggccatcaccaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatcgccgtgagcgccgacggcttcaagttcggcatcagcgagcccggcaaccaggagaagaagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctgcaagaccgaggacagcgacgacatccacttcgagcccgtggtgcagatgcccgagaaggtggagctggtgaccggcgaggagggcgagaaggtgctgtacagccagggcgtgaagctgttcagattcgacgccgagatcagccagtggaaggagagaggcctgggcaacctgaagatcctgaagaacgaggtgaacggcaagcccagaatgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacatggccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagagcctgctgcccgtgatcaacaccatgctgcagctgagccccgaggagaagggcaagctggccgccgtggcccagggcctgcaggagaccagcatccccaagaagaagtag

SEQ ID NO: 96306 - DNA, 5271 bp, Artificial Sequence
  Description of Artificial Sequence: Synthetic coding sequence
atgagaagaagcaaggcctacggcgagagatacctggccagcgtgcagggcagcgcccccagccccggcaagaagctgagaggcttctacttcgccaagctgtactacgaggccaaggagtacgacctggccaagaagtacgtgtgcacctacctgagcgtgcaggagagagaccccagagcccacagattcctgggcctgctgtacgagctggaggagaacaccgagaaggccgtggagtgctacagaagaagcctggagctgaaccccccccagaaggacctggtgctgaagatcgccgagctgctgtgcaagaacgacgtgaccgacggcagagccaagtactgggtggagagagccgccaagctgttccccggcagccccgccatctacaagctgaaggagcacctgctggactgcgagggcgaggacggctggaacaagctgttcgactggatccagagcgagctgtacgtgagacccgacgacgtgcacatgaacatcagactggtggagctgtacagaagcaacaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggcaggccctgagcgagctggccgccctgtgctacgtgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggaggtggtggagaccttcgccaacaagagcggccagagcgtgctgtacaacgccctgttcagcagccagagcagcaaggacaccagcttcctgggcagcgacgacatcggcaacatcgacgtgcaggagcccgagctggaggacctggccagatacgacgtgggcgccatccaggcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagagactgtgcaccgagagacagaagagctggtgggacgccgtgtgcaccctgatccacagaaaggccgtgcccggcaacagcgccgagctgagactggtggtgcagcacgagatcaacaccctgagagcccaggagaagcacggcctgcagcccgccctgctggtgcactgggccaagtgcctgcagaagatgggcagaggcctgaacagcagctacgaccagcaggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatcctggacgccgtgcacggcaacatcgaggacgccgtgaccgccttcgagagcatcaagagcgtggtgagctactggaacctggccctgatcttccacagaaaggccgaggacatcgagaacgacgccgtgttccccgaggagcaggaggagtgcaagaactacctgagaaagaccagagactacctgatcaagatcatcgacgacagcgacagcaacctgagcgtggtgaagaagctgcccgtgcccctggagagcgtgaaggagatgctgaagagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgagaaagatgatctgccaggaggtgaaggccatcaccaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatcgccgtgagcgccgacggcttcaagttcggcatcagcgagcccggcaaccaggagaagaagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctgcaagaccgaggacagcgacgacatccacttcgagcccgtggtgcagatgcccgagaaggtggagctggtgaccggcgaggagggcgagaaggtgctgtacagccagggcgtgaagctgttcagattcgacgccgagatcagccagtggaaggagagaggcctgggcaacctgaagatcctgaagaacgaggtgaacggcaagcccagaatgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacatggccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagagcctgctgcccgtgatcaacaccatgctgcagctgagccccgaggagaagggcaagctggccgccgtggcccagggcctgcaggagaccagcatccccaagaagaagtag

SEQ ID NO: 96307 - DNA, 5247 bp, Artificial Sequence
  Description of Artificial Sequence: Synthetic coding sequence
atgaacgtgatgggcttcaacaccgacagactggcctggaccagaaacaagctgagaggcttctacttcgccaagctgtactacgaggccaaggagtacgacctggccaagaagtacgtgtgcacctacctgagcgtgcaggagagagaccccagagcccacagattcctgggcctgctgtacgagctggaggagaacaccgagaaggccgtggagtgctacagaagaagcctggagctgaaccccccccagaaggacctggtgctgaagatcgccgagctgctgtgcaagaacgacgtgaccgacggcagagccaagtactgggtggagagagccgccaagctgttccccggcagccccgccatctacaagctgaaggagcacctgctggactgcgagggcgaggacggctggaacaagctgttcgactggatccagagcgagctgtacgtgagacccgacgacgtgcacatgaacatcagactggtggagctgtacagaagcaacaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggcaggccctgagcgagctggccgccctgtgctacgtgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggaggtggtggagaccttcgccaacaagagcggccagagcgtgctgtacaacgccctgttcagcagccagagcagcaaggacaccagcttcctgggcagcgacgacatcggcaacatcgacgtgcaggagcccgagctggaggacctggccagatacgacgtgggcgccatccaggcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagagactgtgcaccgagagacagaagagctggtgggacgccgtgtgcaccctgatccacagaaaggccgtgcccggcaacagcgccgagctgagactggtggtgcagcacgagatcaacaccctgagagcccaggagaagcacggcctgcagcccgccctgctggtgcactgggccaagtgcctgcagaagatgggcagaggcctgaacagcagctacgaccagcaggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatcctggacgccgtgcacggcaacatcgaggacgccgtgaccgccttcgagagcatcaagagcgtggtgagctactggaacctggccctgatcttccacagaaaggccgaggacatcgagaacgacgccgtgttccccgaggagcaggaggagtgcaagaactacctgagaaagaccagagactacctgatcaagatcatcgacgacagcgacagcaacctgagcgtggtgaagaagctgcccgtgcccctggagagcgtgaaggagatgctgaagagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgagaaagatgatctgccaggaggtgaaggccatcaccaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatcgccgtgagcgccgacggcttcaagttcggcatcagcgagcccggcaaccaggagaagaagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctgcaagaccgaggacagcgacgacatccacttcgagcccgtggtgcagatgcccgagaaggtggagctggtgaccggcgaggagggcgagaaggtgctgtacagccagggcgtgaagctgttcagattcgacgccgagatcagccagtggaaggagagaggcctgggcaacctgaagatcctgaagaacgaggtgaacggcaagcccagaatgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacatggccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagagcctgctgcccgtgatcaacaccatgctgcagctgagccccgaggagaagggcaagctggccgccgtggcccagggcctgcaggagaccagcatccccaagaagaagtag

SEQ ID NO: 96308 - DNA, 1935 bp, Artificial Sequence
  Description of Artificial Sequence: Synthetic coding sequence
atgctgatgagaagagaccaggtgctgaaggtgtgcgccaaccactggatcaccaccaccatgaacctgaagcccctgagcggcagcgacagagcctggatgtggctggccagcgacttcagcgacggcgacgccaagctggagagactggccgcccagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactacgacctgagagaggacgccctggacgacaacgtgagcagcagcagcgtgcacgacagccccctggccagcagccccgtgagaaagaacatcttcagattcgacgagagcaccaccggcttcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacatggccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaaccccttcgccttcggcaacagcagcgccaccggcagcctgttcggcttcagcttcaacgcccccctgaagagcaacgacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccagctgaacggcctgctgagagagaccgaggccaccagcgccgtgctgatggagcagatcaagctgctgaagagcgagatcagaagactggagagaaaccaggaggagagcgccgccaacgtggagcacctgaagaacgtgctgctgcagttcatcttcctgaagcccggcagcgagagagagcccagcagctgctacaagtacgacgtggccgcccagccctag

SEQ ID NO: 96309 - DNA, 5301 bp, Artificial Sequence
  Description of Artificial Sequence: Synthetic coding sequence
atgagctgcagcaaggcctacggcgagagatacgtggccagcgtgcagggcagcgcccccagccccagaaagaagagcaccagaggcttctacttcgccaagctgtactacgaggccaaggagtacgacctggccaagaagtacatctgcacctacatcaacgtgagagagatggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccgagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaagaagagcgagaagcccctggagaacgacaccggcctgcaggcccaggacatcagcggcagaaagaagggcagaggcgtgatcttcggccagaccagcagcaccttcaccttcgccgacgtggccaagagcaccagcggcgagggcttccagttcggcaagaaggacctgaacttcaagggcttcagcggcgccggcgagaagctgttcagcagccagtacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggagggcgagaaggtgctgtacagccagggcgtgaagctgttcagattcgacgccgaggtgagccagtggaaggagagaggcctgggcaacctgaagatcctgaagaacgaggtgaacggcaaggtgagaatgctgatgcagagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtggccgaggaggagaacaagggcagcggcaccggcgccgccggcgccagcgacaccaccatcaagcccaacgccgagaacaccggccccaccctggagtgggacaactacgacctgagagaggacgccctggacgacagcgtgagcagcagcagcgtgcacgccagccccctggccagcagccccgtgagaaagaacctgttccacttcgacgagagcaccaccggcagcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccgagttctacagatacgacaaggacgtgggccagtggaaggagagaggcatcggcgacatcaagatcctgcagaactacgacaacaagcacgtgagaatcctgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaagcccttcgccttcggcaacagcagcgccaccggcagcctgttcggcttcagcttcaacgcccccctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccaccgaggagagcagcatcaactacaccttcaagacccccgagaaggagccccccctgtggtacgccgagttcaccaaggaggagctggtgcagaagctgagcagcaccaccaagagcgccgaccacctgaacggcctgctgagagagatcgaggccaccaacgccgtgctgatggagcagatcaagctgctgaagagcgagatcagaagactggagagaaaccaggagcaggaggtgagcgccgccaacgtggagcacctgaagaacgtgctgctgcagttcatcttcctgaagcccggcagcgagagagagagactgctgcccgtgatcaacaccatgctgcagctgagcctggaggagaagggcaagctggccgccgtggcccaggccgagagaggcttcgtgctgaacagcaccttctag

SEQ ID NO: 96310 - DNA, 471 bp, Artificial Sequence
  Description of Artificial Sequence: Synthetic coding sequence
atggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccgagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaagttctag

SEQ ID NO: 96311 - DNA, 3378 bp, Artificial Sequence
  Description of Artificial Sequence: Synthetic coding sequence
atgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaagaagagcgagaagcccctggagaacgacaccggcctgcaggcccaggacatcagcggcagaaagaagggcagaggcgtgatcttcggccagaccagcagcaccttcaccttcgccgacgtggccaagagcaccagcggcgagggcttccagttcggcaagaaggacctgaacttcaagggcttcagcggcgccggcgagaagctgttcagcagccagtacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggagggcgagaaggtgctgtacagccagggcgtgaagctgttcagattcgacgccgaggtgagccagtggaaggagagaggcctgggcaacctgaagatcctgaagaacgaggtgaacggcaaggtgagaatgctgatgcagagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcagcgagagcaaggtggagcccaagaagtgcgagctgagcaagaacagcgacatcgagcagagcagcgacagcaaggtgaagaacctgagcgccagcttccccaccgaggagagcagcatcaactacaccttcaagacccccgagaaggagccccccctgtggtacgccgagttcaccaaggaggagctggtgcagaagctgagcagcaccaccaagagcgccgaccacctgaacggcctgctgagagagatcgaggccaccaacgccgtgctgatggagcagatcaagctgctgaagagcgagatcagaagactggagagaaaccaggagcaggaggtgagcgccgccaacgtggagcacctgaagaacgtgctgctgcagttcatcttcctgaagcccggcagcgagagagagagactgctgcccgtgatcaacaccatgctgcagctgagcctggaggagaagggcaagctggccgccgtggcccagggcgaggagtag

SEQ ID NO: 96312 - DNA, 423 bp, Artificial Sequence
  Description of Artificial Sequence: Synthetic coding sequence
accgaggagagcagcatcaactacaccttcaagacccccgagaaggagccccccctgtggtacgccgagttcaccaaggaggagctggtgcagaagctgagcagcaccaccaagagcgccgaccacctgaacggcctgctgagagagatcgaggccaccaacgccgtgctgatggagcagatcaagctgctgaagagcgagatcagaagactggagagaaaccaggagcaggaggtgagcgccgccaacgtggagcacctgaagaacgtgctgctgcagttcatcttcctgaagcccggcagcgagagagagagactgctgcccgtgatcaacaccatgctgcagctgagcctggaggagaagggcaagctggccgccgtggcccagggcctgcaggagaccagcatccccaagaagaagtag

SEQ ID NO: 96313 - DNA, 5277 bp, Artificial Sequence
  Description of Artificial Sequence: Synthetic coding sequence
atgagctgcagcaaggcctacggcgagagatacgtggccagcgtgcagggcagcgcccccagccccagaaagaagagcaccagaggcttctacttcgccaagctgtactacgaggccaaggagtacgacctggccaagaagtacatctgcacctacatcaacgtgagagagatggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccgagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcggccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaagaagagcgagaagcccctggagaacgacaccggcctgcaggcccaggacatcagcggcagaaagaagggcagaggcgtgatcttcggccagaccagcagcaccttcaccttcgccgacgtggccaagagcaccagcggcgagggcttccagttcggcaagaaggacctgaacttcaagggcttcagcggcgccggcgagaagctgttcagcagccagtacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggagggcgagaaggtgctgtacagccagggcgtgaagctgttcagattcgacgccgaggtgagccagtggaaggagagaggcctgggcaacctgaagatcctgaagaacgaggtgaacggcaaggtgagaatgctgatgcagagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtggccgaggaggagaacaagggcagcggcaccggcgccgccggcgccagcgacaccaccatcaagcccaacgccgagaacaccggccccaccctggagtgggacaactacgacctgagagaggacgccctggacgacagcgtgagcagcagcagcgtgcacgccagccccctggccagcagccccgtgagaaagaacctgttccacttcgacgagagcaccaccggcagcaacttcagcttcaagagcgccctgagcctgagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagcaggtggtgttcagccacagagccgagttctacagatacgacaaggacgtgggccagtggaaggagagaggcatcggcgacatcaagatcctgcagaactacgacaacaagcacgtgagaatcctgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaagcccttcgccttcggcaacagcagcgccaccggcagcctgttcggcttcagcttcaacgcccccctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccaccgaggagagcagcatcaactacaccttcaagacccccgagaaggagccccccctgtggtacgccgagttcaccaaggaggagctggtgcagaagctgagcagcaccaccaagagcgccgaccacctgaacggcctgctgagagagatcgaggccaccaacgccgtgctgatggagcagatcaagctgctgaagagcgagatcagaagactggagagaaaccaggagcaggaggtgagcgccgccaacgtggagcacctgaagaacgtgctgctgcagttcatcttcctgaagcccggcagcgagagagagagactgctgcccgtgatcaacaccatgctgcagctgagcctggaggagaagggcaagctggccgccgtggcccagggcgaggagtag

SEQ ID NO: 96314 - DNA, 5301 bp, Artificial Sequence
  Description of Artificial Sequence: Synthetic coding sequence
atgagctgcagcaaggcctacggcgagagatacgtggccagcgtgcagggcagcgcccccagccccagaaagaagagcaccagaggcttctacttcgccaagctgtactacgaggccaaggagtacgacctggccaagaagtacatctgcacctacatcaacgtgagagagatggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcgaccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaaggagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctacaagaccgaggacagcgacgacatccacttcgagcccgtggtgcagatgcccgagaaggtggagctggtgatcggcgaggagggcgagaaggtgctgtacagccagggcgtgaagctgttcagattcgacgccgaggtgagacagtggaaggagagaggcctgggcaacctgaagatcctgaagaacgaggtgaacggcaagcccagaatgctgatgagaagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagcagctgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactgcgacctgagagaggacgccctggacgacagcgtgagcagcagcagcgtgcacgccagccccctggccagcagccccgtgagaaagaacctgttccacttcggcgagagcaccaccggcagcaacttcagcttcaagagcgccctgagccccagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagaaggtggtgttcagccacagagccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacaccatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaagcccttcgccttcggcaacagcagcgccaccggcagcctgttcggcttcagcttcaacgccagcctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccacctgaacggcctgctgagagaggccgaggccaccagcgccgtgctgatggagcagatcaagctgctgaagagcgagatcagaagactggagagaaaccaggagcaggaggagagcgccgccaacgtggagcacctgaagaacgtgctgctgcagttcatcttcctgaagcccggcagcgagagagagagactgctgcccgtgatcaacaccatgctgcagctgagccccgaggagaagggcaagctggccgccgtggcccaggccgagagaggcttcgtgctgaacagcaccttctag

SEQ ID NO: 96315 - DNA, 3378 bp, Artificial Sequence
  Description of Artificial Sequence: Synthetic coding sequence
atgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcgaccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaaggagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctacaagaccgaggacagcgacgacatccacttcgagcccgtggtgcagatgcccgagaaggtggagctggtgatcggcgaggagggcgagaaggtgctgtacagccagggcgtgaagctgttcagattcgacgccgaggtgagacagtggaaggagagaggcctgggcaacctgaagatcctgaagaacgaggtgaacggcaagcccagaatgctgatgagaagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagcagctgctgctggacatccccctgcagaccccccacaagctggtggacaccggcagagccgccaagctgatccagagagccgaggagatgaagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccacctgaacggcctgctgagagaggccgaggccaccagcgccgtgctgatggagcagatcaagctgctgaagagcgagatcagaagactggagagaaaccaggagcaggaggagagcgccgccaacgtggagcacctgaagaacgtgctgctgcagttcatcttcctgaagcccggcagcgagagagagagactgctgcccgtgatcaacaccatgctgcagctgagccccgaggagaagggcaagctggccgccgtggcccagggcgaggagtag

SEQ ID NO: 96316 - DNA, 471 bp, Artificial Sequence
  Description of Artificial Sequence: Synthetic coding sequence
atggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaagttctag

SEQ ID NO: 96317 - DNA, 5277 bp, Artificial Sequence
  Description of Artificial Sequence: Synthetic coding sequence
atgagctgcagcaaggcctacggcgagagatacgtggccagcgtgcagggcagcgcccccagccccagaaagaagagcaccagaggcttctacttcgccaagctgtactacgaggccaaggagtacgacctggccaagaagtacatctgcacctacatcaacgtgagagagatggaccccagagcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggccagatgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagagcagagagctgctggagagcttcgacagcgccctgcagagcgccaagagcagcctgggcggcaacgacgagctgagcgccaccttcctggagatgaagggccacttctacatgcacgccggcagcctgctgctgaagatgggccagcacggcaacaacgtgcagtggagagccctgagcgagctggccgccctgtgctacctgatcgccttccaggtgcccagacccaagatcaagctgatcaagggcgaggccggccagaacctgctggagatgatggcctgcgacagactgagccagagcggccacatgctgctgaacctgagcagaggcaagcaggacttcctgaaggtggtggtggagaccttcgccaacaagagcggccagagcgccctgtacgacgccctgttcagcagccagagccccaaggacaccagcttcctgggcagcgacgacatcggcaacatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccaccacctgccccaggagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccctgcccgtgtgcaagcagctgtgcaccgagagacagaagagctggtgggacgccgtgtgcaccctgatccacagaaaggccgtgcccggcaacagcgccaagctgagactgctggtgcagcacgagatcaacaccctgagagcccaggagaagcacggcctgcagcccgccctgctggtgcactgggccaagtgcctgcagaagatgggcagcggcctgaacagcttctacgaccagagagagtacatcggcagaagcgtgcactactggaagaaggtgctgcccctgctgaagatcatcaagaagaagaacagcatccccgagcccatcgaccccctgttcaagcacttccacagcgtggacatccaggccagcgagatcgtggagtacgaggaggacgcccacgtgaccttcgccatcctggacgccgtgaacggcaacatcgaggacgccatgaccgccttcgagagcatcaagagcgtggtgagctactggaacctggccctgatcttccacagaaaggccgaggacatcgccaacgacgccctgagccccgaggagcaggaggagtgcaagaactacctgagaaagaccagaggctacctgatcaagatcctggacgacagcgacagcaacctgagcgtggtgaagaagctgcccgtgcccctggagagcgtgaaggagatgctgaagagcgtgatgcaggagctggagaactacagcgagggcgaccccctgtacaagaacggcagcctgagaaacgccgacagcgagatcaagcacagcacccccagccccaccaagtacagcctgagccccagcaagagctacaagtacagccccaagaccccccccagatgggccgaggaccagaacagcctgctgaagatgatcagacaggaggtgaaggccatcaaggaggagatgcaggagctgaagctgaacagcagcaagagcgccagccaccacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaaggagagcgagaagcccctggagaacgacaccggcttccaggcccaggacatcagcggccagaagaacggcagaggcgtgatcttcggccagaccagcagcaccttcaccttcgccgacgtggccaagagcaccagcggcgagggcttccagttcggcaagaaggaccccaacttcaagggcttcagcggcgccggcgagaagctgttcagcagccagtgcggcaagatggccaacaaggccaacaccagcggcgacttcgagaaggacgacgacgcctacaagaccgaggacagcgacgacatccacttcgagcccgtggtgcagatgcccgagaaggtggagctggtgatcggcgaggagggcgagaaggtgctgtacagccagggcgtgaagctgttcagattcgacgccgaggtgagacagtggaaggagagaggcctgggcaacctgaagatcctgaagaacgaggtgaacggcaagcccagaatgctgatgagaagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagcagctgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaaccccgagaacaccggccccaccctggagtgggacaactgcgacctgagagaggacgccctggacgacagcgtgagcagcagcagcgtgcacgccagccccctggccagcagccccgtgagaaagaacctgttccacttcggcgagagcaccaccggcagcaacttcagcttcaagagcgccctgagccccagcaagagccccgccaagctgaaccagagcggcaccagcgtgggcaccgacgaggagagcgacgtgacccaggaggaggagagagacggccagtacttcgagcccgtggtgcccctgcccgacctggtggaggtgagcagcggcgaggagaacgagaaggtggtgttcagccacagagccgagctgtacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacaccatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcggcagcgagagcgtgaagagaatcttcagcagcgagaagagcaagcccttcgccttcggcaacagcagcgccaccggcagcctgttcggcttcagcttcaacgccagcctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccatggaggagagcagcatcaactacaccttcaagacccccgagaaggagccccccctgtggcacgccgagttcaccaaggaggagctggtgcagaagctgagcagcaccaccaagagcgccgaccacctgaacggcctgctgagagaggccgaggccaccagcgccgtgctgatggagcagatcaagctgctgaagagcgagatcagaagactggagagaaaccaggagcaggaggagagcgccgccaacgtggagcacctgaagaacgtgctgctgcagttcatcttcctgaagcccggcagcgagagagagagactgctgcccgtgatcaacaccatgctgcagctgagccccgaggagaagggcaagctggccgccgtggcccagggcgaggagtag

SEQ ID NO: 96318 - DNA, 5298 bp, Artificial Sequence
  Description of Artificial Sequence: Synthetic coding sequence
atgagaagaagcaaggccgacgtggagagatacgtggccagcgtgctgggcctgacccccagccccagacagaagagcatgaagggcttctacttcgccaagctgtactacgaggccaaggagtacgacctggccaagaagtacatctgcacctacatcaacgtgcaggagagagaccccaaggcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggcccactgccacgaggccgagagaaacatcgccctgagaagcagcctggagtggaacagctgcgtggtgcagaccctgaaggagtacctggagagcctgcagtgcctggagagcgacaagagcgactggcaggccaccaacaccgacctgctgctggcctacgccaacctgatgctgctgaccctgagcaccagagacgtgcaggagaacagagagctgctggagagcttcgacagcgccctgcagagcgccaagagcagcctgggcggcaacgacgagctgagcgccaccttcctggagatgaagggccacttctacatgtacgccggcagcctgctgctgaagatgggccagcacggcaacaacgtgcagtggagagccctgagcgagctggccgccctgtgctacctgatcgccttccaggtgcccagacccaagatcaagctgagagagggcaaggccggccagaacctgctggagatgatggcctgcgacagactgagccagagcggccacatgctgctgagcctgagcagaggcaagcaggacttcctgaaggaggtggtggagaccttcgccaacaagatcggccagagcgccctgtacgacgccctgttcagcagccagagccccaaggacaccagcttcctgggcagcgacgacatcggcaagatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccacagactgccccacgagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccttccccgtgtgcaagcagctgtgcaccgagagacagaagagctggtgggacgccgtgtgcaccctgatccacagaaaggccgtgcccggcaacctggccaagctgagactgctggtgcagcacgagatcaacaccctgagagcccaggagaagcacggcctgcagcccgccctgctggtgcactgggccaagtacctgcagaagaccggcagcggcctgaacagcttctacggccagctggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatgctggacgccgtgaacggcaacatcgaggacgccgtgaccgccttcgagagcatcaagagcgtggtgagctactggaacctggccctgatcttccacagaaaggccgaggacatcgagaacgacgccctgagccccgaggagcaggaggagtgcagaaactacctgaccaagaccagagactacctgatcaagatcatcgacgacggcgacagcaacctgagcgtggtgaagaagctgcccgtgcccctggagagcgtgaagcagatgctgaacagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccgagaccccccccagatggaccgaggacagaaacagcctgctgaacatgatctgccagcaggtggaggccatcaagaaggagatgcaggagctgaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaagaagagagagaagcccctggagaacgacaccggcttccaggcccaggacatcagcggcagaaagaagggcagaggcgtgatcttcggccagaccagcagcaccttcaccttcgccgacgtggccaagagcaccagcggcgagggcttccagttcggcaagaaggacctgaacttcaagggcttcagcggcgccggcgagaagctgttcagcagcagatacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggagggcgagaaggtgctgtacagccagggcgtgaagctgttcagattcgacgccgaggtgagacagtggaaggagagaggcctgggcaacctgaagatcctgaagaacgaggtgaacggcaagctgagaatgctgatgagaagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgccgccggcgccagcgacaccaccatcaagcccaacgccgagaacaccggccccaccctggagtgggacaactacgacctgagagaggacgccctggacgacagcgtgagcagcagcagcgtgcacgccagccccctggccagcagccccgtgagaaagaacctgttcagattcgacgagagcaccaccggcagcaacttcagcttcaagagcgccctgagcctgagcaagagccccgccaagctgaaccagagcggcaccagcgtgggcaccgacgaggagagcgtggtgacccaggaggaggagagagacggccagtacttcgagcccgtggtgcccctgcccgacctggtggaggtgagcagcggcgaggagaacgagcaggtggtgttcagccacagagccgagatctacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccatcctggaggagaccaccagagagagaaccgacgtgatccagggcgacgacgtggccgacgccgccagcgaggtggaggtgagcagcaccagcgagaccaccaccaaggccgtggtgagcccccccaagttcgtgttcgtgagcgagagcgtgaagagaatcttcagcagcgagaagagcaagcccttcgtgttcggcaacagcagcgccaccggcagcctgttcggcttcagcttcaacgcccccctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccaccgaggagagcagcatcaactacaccttcaagacccccgagaaggagccccccctgtggcacgccgagttcaccaaggaggagctggtgcagaagctgagaagcaccaccaagagcgccgaccacctgaacggcctgctgagagagatcgaggccaccaacgccgtgctgatggagcagatcaagctgctgaagagcgagatcagaagactggagagaaaccaggagagagagaagagcgccgccaacctggagtacctgaagaacgtgctgctgcagttcatcttcctgaagcccggcagcgagagagagagactgctgcccgtgatcaacaccatgctgcagctgagccccgaggagaagggcaagctggccgccgtggcccaggacgaggaggagaacgccagcagaagcagcggctag

SEQ ID NO: 96319 - DNA, 2715 bp, Artificial Sequence
  Description of Artificial Sequence: Synthetic coding sequence
atgagaagaagcaaggccgacgtggagagatacgtggccagcgtgctgggcctgacccccagccccagacagaagagcatgaagggcttctacttcgccaagctgtactacgaggccaaggagtacgacctggccaagaagtacatctgcacctacatcaacgtgcaggagagagaccccaaggcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggcccactgccacgaggccgagagaaacatcgccctgagaagcagcctggagtggaacagctgcgtggtgcagaccctgaaggagtacctggagagcctgcagtgcctggagagcgacaagagcgactggcaggccaccaacaccgacctgctgctggcctacgccaacctgatgctgctgaccctgagcaccagagacgtgcaggagaacagagagctgctggagagcttcgacagcgccctgcagagcgccaagagcagcctgggcggcaacgacgagctgagcgccaccttcctggagatgaagggccacttctacatgtacgccggcagcctgctgctgaagatgggccagcacggcaacaacgtgcagtggagagccctgagcgagctggccgccctgtgctacctgatcgccttccaggtgcccagacccaagatcaagctgagagagggcaaggccggccagaacctgctggagatgatggcctgcgacagactgagccagagcggccacatgctgctgagcctgagcagaggcaagcaggacttcctgaaggaggtggtggagaccttcgccaacaagatcggccagagcgccctgtacgacgccctgttcagcagccagagccccaaggacaccagcttcctgggcagcgacgacatcggcaagatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccacagactgccccacgagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccttccccgtgtgcaagcagctgtgcaccgagagacagaagagctggtgggacgccgtgtgcaccctgatccacagaaaggccgtgcccggcaacctggccaagctgagactgctggtgcagcacgagatcaacaccctgagagcccaggagaagcacggcctgcagcccgccctgctggtgcactgggccaagtacctgcagaagaccggcagcggcctgaacagcttctacggccagctggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatgctggacgccgtgaacggcaacatcgaggacgccgtgaccgccttcgagagcatcaagagcgtggtgagctactggaacctggccctgatcttccacagaaaggccgaggacatcgagaacgacgccctgagccccgaggagcaggaggagtgcagaaactacctgaccaagaccagagactacctgatcaagatcatcgacgacggcgacagcaacctgagcgtggtgaagaagctgcccgtgcccctggagagcgtgaagcagatgctgaacagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccgagaccccccccagatggaccgaggacagaaacagcctgctgaacatgatctgccagcaggtggaggccatcaagaaggagatgcaggagctgaagctgaacagcagcaagagcgccagcagacacagatggcccaccgagaactacggccccgacagcgtgcccgacggctaccagggcagccagaccttccacggcgcccccctgaccgaggccgcccacagacacttcaccatcgagaagcacggcgacagcaagtggatcatctacagattcaccaagcagctgtgcggcaccgagagagccagagccaagatcagctag

SEQ ID NO: 96320 - DNA, 459 bp, Artificial Sequence
  Description of Artificial Sequence: Synthetic coding sequence
atgtggagcggcaccagccccagatgctgggtgagccccagaagactggacagatacatctgcacctacatcaacgtgcaggagagagaccccaaggcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgtag

SEQ ID NO: 96321 - DNA, 2715 bp, Artificial Sequence; identical to SEQ ID NO: 96319
  Description of Artificial Sequence: Synthetic coding sequence

SEQ ID NO: 96322 - DNA, 5298 bp, Artificial Sequence; identical to SEQ ID NO: 96318
  Description of Artificial Sequence: Synthetic coding sequence

SEQ ID NO: 96323 - DNA, 2715 bp, Artificial Sequence; identical to SEQ ID NO: 96319
  Description of Artificial Sequence: Synthetic coding sequence

SEQ ID NO: 96324 - DNA, 5298 bp, Artificial Sequence
  Description of Artificial Sequence: Synthetic coding sequence
atgagaagaagcaaggccgacgtggagagatacgtggccagcgtgctgggcctgacccccagccccagacagaagagcatgaagggcttctacttcgccaagctgtactacgaggccaaggagtacgacctggccaagaagtacatctgcacctacatcaacgtgcaggagagagaccccaaggcccacagattcctgggcctgctgtacgagctggaggagaacaccgagaaggccgtggagtgctacagaagaagcgtggagctgaaccccacccagaaggacctggtgctgaagatcgccgagctgctgtgcaagaacgacgtgaccgacggcagagccaagtactgggtggagagagccgccaagctgttccccggcagccccgccatctacaagctgaaggagcagctgctggactgcgagggcgaggacggctggaacaagctgttcgacctgatccagagcgagctgtacgtgagacccgacgacgtgcacgtgaacatcagactggtggagctgtacagaagcaccaagagactgaaggacgccgtggcccactgccacgaggccgagagaaacatcgccctgagaagcagcctggagtggaacagctgcgtggtgcagaccctgaaggagtacctggagagcctgcagtgcctggagagcgacaagagcgactggagagccaccaacaccgacctgctgctggcctacgccaacctgatgctgctgaccctgagcaccagagacgtgcaggagaacagagagctgctggagagcttcgacagcgccctgcagagcgccaagagcagcctgggcggcaacgacgagctgagcgccaccttcctggagatgaagggccacttctacatgtacgccggcagcctgctgctgaagatgggccagcacggcaacaacgtgcagtggagagccctgagcgagctggccgccctgtgctacctgatcgccttccaggtgcccagacccaagatcaagctgagagagggcaaggccggccagaacctgctggagatgatggcctgcgacagactgagccagagcggccacatgctgctgagcctgagcagaggcaagcaggacttcctgaaggaggtggtggagaccttcgccaacaagatcggccagagcgccctgtacgacgccctgttcagcagccagagccccaaggacaccagcttcctgggcagcgacgacatcggcaagatcgacgtgcaggagcccgagctggaggacctggccagatacgacgtgggcgccatcagagcccacaacggcagcctgcagcacctgacctggctgggcctgcagtggaacagcctgcccgccctgcccggcatcagaaagtggctgaagcagctgttccacagactgccccacgagaccagcagactggagaccaacgcccccgagagcatctgcatcctggacctggaggtgttcctgctgggcgtggtgtacaccagccacctgcagctgaaggagaagtgcaacagccaccacagcagctaccagcccctgtgcctgcccttccccgtgtgcaagcagctgtgcaccgagagacagaagagctggtgggacgccgtgtgcaccctgatccacagaaaggccgtgcccggcaacctggccaagctgagactgctggtgcagcacgagatcaacaccctgagagcccaggagaagcacggcctgcagcccgccctgctggtgcactgggccaagtacctgcagaagaccggcagcggcctgaacagcttctacggccagctggagtacatcggcagaagcgtgcactactggaagaaggtgctgcccctgctgaagatcatcaagaagaacagcatccccgagcccatcgaccccctgttcaagcacttccacagcgtggacatccaggccagcgagatcgtggagtacgaggaggacgcccacatcaccttcgccatcctggacgccgtgaacggcaacatcgaggacgccgtgaccgccttcgagagcatcaagagcgtggtgagctactggaacctggccctgatcttccacagaaaggccgaggacatcgagaacgacgccctgagccccgaggagcaggaggagtgcagaaactacctgaccaagaccagagactacctgatcaagatcatcgacgacggcgacagcaacctgagcgtggtgaagaagctgcccgtgcccctggagagcgtgaagcagatgctgaacagcgtgatgcaggagctggaggactacagcgagggcggccccctgtacaagaacggcagcctgagaaacgccgacagcgagatcaagcacagcacccccagccccaccaagtacagcctgagccccagcaagagctacaagtacagccccgagaccccccccagatggaccgaggacagaaacagcctgctgaacatgatctgccagcaggtggaggccatcaagaaggagatgcaggagctgaagctgaacagcagcaagagcgccagcagacacagatggcccaccgagaactacggccccgacagcgtgcccgacggctaccagggcagccagaccttccacggcgcccccctgaccgtggccaccaccggccccagcgtgtactacagccagagccccgcctacaacagccagtacctgctgagacccgccgccaacgtgacccccaccaagggcagcagcaacaccgagttcaagagcaccaaggagggcttcagcatccccgtgagcgccgacggcttcaagttcggcatcagcgagcccggcaaccaggagaagaagagagagaagcccctggagaacgacaccggcctgcaggcccaggacatcagaggcagaaagaagggcagaggcgtgatcttcggccagaccagcagcaccttcaccttcgccgacgtggccaagagcaccagcggcgagggcttccagttcggcaagaaggacctgaacttcaagggcttcagcggcgccggcgagaagctgttcagcagcagatacggcaagatggccaacaaggccaacaccagcggcgacttcgagaaggacgacgacgcctacaagaccgaggacagcgacgacatccacttcgagcccgtggtgcagatgcccgagaaggtggagctggtgaccggcgaggagggcgagaaggtgctgtacagccagggcgtgaagctgttcagattcgacgccgaggtgagacagtggaaggagagaggcctgggcaacctgaagatcctgaagaacgaggtgaacggcaagctgagaatgctgatgagaagagagcaggtgctgaaggtgtgcgccaaccactggatcaccaccaccatgaacctgaagcccctgagcggcagcgacagagcctggatgtggagcgccagcgacttcagcgacggcgacgccaagctggagagactggccgccaagttcaagacccccgagctggccgaggagttcaagcagaagttcgaggagtgccagagactgctgctggacatccccctgcagaccccccacaagctggtggacaccggcagagccgccaagctgatccagagagccgaggagatgaagagcggcctgaaggacttcaagaccttcctgaccaacgaccagaccaaggtgaccgaggaggagaacaagggcagcggcaccggcgtggccggcgccagcgacaccaccatcaagcccaacgccgagaacaccggccccaccctggagtgggacaactacgacctgagagaggacgccctggacgacagcgtgagcagcagcagcgtgcacgccagccccctggccagcagccccgtgagaaagaacctgttcagattcgacgagagcaccaccggcagcaacttcagcttcaagagcgccctgagcctgagcaagagccccgccaagctgaaccagagcggcaccagcgtgggcaccgacgaggagagcgtggtgacccaggaggaggagagagacggccagtacttcgagcccgtggtgcccctgcccgacctggtggaggtgagcagcggcgaggagaacgagcaggtggtgttcagccacagagccgagatctacagatacgacaaggacgtgggccagtggaaggagagaggcatcggcgacatcaagatcctgcagaactacgacaacaagcaggtgagaatcgtgatgagaagagaccaggtgctgaagctgtgcgccaaccacagaatcacccccgacatgagcctgcagaacatgaagggcaccgagagagtgtgggtgtggaccgcctgcgacttcgccgacggcgagagaaaggtggagcacctggccgtgagattcaagctgcaggacgtggccgacagcttcaagaagatcttcgacgaggccaagaccgcccaggagaaggacagcctgatcaccccccacgtgagcagaagcagcacccccagagagagcccctgcggcaagatcgccgtggccgtgctggaggagatcaccagagagagaaccgacgtgatccagggcgacgacgtggccgacgccgccagcgaggtggaggtgagcagcaccagcgagaccaccaccaaggccgtggtgagcccccccaagttcgtgttcgtgagcgagagcgtgaagagaatcttcagcagcgagaagagcaagcccttcgccttcggcaacagcagcgccaccggcagcctgttcggcttcagcttcaacgcccccctgaagagcaacaacagcgagaccagcagcgtggcccagagcggcagcgagagcaaggtggagcccaagaagtgcgagctgagcaagaacagcgacatcgagcagagcagcgacagcaaggtgaagaacctgagcgccagcttccccaccgaggagagcagcatcaactacaccttcaagacccccgagaaggagccccccctgtggcacgccgagttcaccaaggaggagctggtgcagaagctgagaagcaccaccaagagcgccgaccacctgaacggcctgctgagagagatcgaggccaccaacgccgtgctgatggagcagatcaagctgctgaagagcgagatcagaagactggagagaaaccaggagagagagaagagcgccgccaacctggagtacctgaagaacgtgctgctgcagttcatcttcctgaagcccggcagcgagagagagagactgctgcccgtgatcaacaccatgctgcagctgagccccgaggagaagggcaagctggccgccgtggcccaggacgaggaggagaaccccagcagaagcagcggctag

SEQ ID NO: 96325 - DNA, 1407 bp, Artificial Sequence
  Description of Artificial Sequence: Synthetic coding sequence
atgggcaccgccacccccgacggcagagaggaccaggagagactgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgaggcctaccaggtgcccgccagctaccagcccgacgaggaggagagagccagactggccggcgaggaggaggccctgagacagtaccagcagagaaagcagcagcagcaggagggcaactacctgcagcacgtgcagctggaccagagaagcctggtgctgaacaccgagcccgccgagtgccccgtgtgctacagcgtgctggcccccggcgaggccgtggtgctgagagagtgcctgcacaccttctgcagagagtgcctgcagggcaccatcagaaacagccaggaggccgaggtgagctgccccttcatcgacaacacctacagctgcagcggcaagctgctggagagagagatcaaggccctgctgacccccgaggactaccagagattcctggacctgggcatcagcatcgccgagaacagaagcgccttcagctaccactgcaagacccccgactgcaagggctggtgcttcttcgaggacgacgtgaacgagttcacctgccccgtgtgcttccacgtgaactgcctgctgtgcaaggccatccacgagcagatgaactgcaaggagtaccaggaggacctggccctgagagcccagaacgacgtggccgccagacagaccaccgagatgctgaaggtgatgctgcagcagggcgaggccatgagatgcccccagtgccagatcgtggtgcagaagaaggacggctgcgactggatcagatgcaccgtgtgccacaccgagatctgctgggtgaccaagggccccagatggggccccggcggccccggcgacaccagcggcggctgcagatgcagagtgaacggcatcccctgccaccccagctgccagaactgccactag

SEQ ID NO: 96326 - DNA, 1533 bp, Artificial Sequence
  Description of Artificial Sequence: Synthetic coding sequence
atggacgagaagaccaagaaggccgaggagatggccctgagcctgaccagagccgtggccggcggcgacgagcaggtggccatgaagtgcgccatctggctggccgagcagagagtgcccctgagcgtgcagctgaagcccgaggtgagccccacccaggacatcagactgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgaggcctaccaggtgcccgccagctaccagcccgacgaggaggagagagccagactggccggcgaggaggaggccctgagacagtaccagcagagaaagcagcagcagcaggagggcaactacctgcagcacgtgcagctggaccagagaagcctggtgctgaacaccgagcccgccgagtgccccgtgtgctacagcgtgctggcccccggcgaggccgtggtgctgagagagtgcctgcacaccttctgcagagagtgcctgcagggcaccatcagaaacagccaggaggccgaggtgagctgccccttcatcgacaacacctacagctgcagcggcaagctgctggagagagagatcaaggccctgctgacccccgaggactaccagagattcctggacctgggcatcagcatcgccgagaacagaagcgccttcagctaccactgcaagacccccgactgcaagggctggtgcttcttcgaggacgacgtgaacgagttcacctgccccgtgtgcttccacgtgaactgcctgctgtgcaaggccatccacgagcagatgaactgcaaggagtaccaggaggacctggccctgagagcccagaacgacgtggccgccagacagaccaccgagatgctgaaggtgatgctgcagcagggcgaggccatgagatgcccccagtgccagatcgtggtgcagaagaaggacggctgcgactggatcagatgcaccgtgtgccacaccgagatctgctgggtgaccaagggccccagatggggccccggcggccccggcgacaccagcggcggctgcagatgcagagtgaacggcatcccctgccaccccagctgccagaactgccactag

SEQ ID NO: 96327 - DNA, 1011 bp, Artificial Sequence
  Description of Artificial Sequence: Synthetic coding sequence
atggacgagaagaccaagaaggccgaggagatggccctgagcctgaccagagccgtggccggcggcgacgagcaggtggccatgaagtgcgccatctggctggccgagcagagagtgcccctgagcgtgcagctgaagcccgaggtgagccccacccaggacatcagactgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgaggcctaccaggtgcccgccagctaccagcccgacgaggaggagagagccagactggccggcgaggaggaggccctgagacagtaccagcagagaaagcagcagcagcaggagggcaactacctgcagcacgtgcagctggaccagagaagcctggtgctgaacaccgagcccgccgagtgccccgtgtgctacagcgtgctggcccccggcgaggccgtggtgctgagaagcgcctgcagagcccccagcgccaccgccagaagaagaagaagccccgcccccagcctgaccacccccaccagagccagagccagctgctggagaggcagaagcagaagaagctag

SEQ ID NO: 96328 - DNA, 792 bp, Artificial Sequence
  Description of Artificial Sequence: Synthetic coding sequence
atggacgagaagaccaagaaggccgaggagatggccctgagcctgaccagagccgtggccggcggcgacgagcaggtggccatgaagtgcgccatctggctggccgagcagagagtgcccctgagcgtgcagctgaagcccgaggtgagccccacccaggacatcagaagcagaggcgagaagaccgaggaggtgggcgaggtgagagaggtgcccgaccacggcggccccagagtgctgcccagagtggacagcaagagcagcgtggagcccctggagggccccaactggctgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgagtag

SEQ ID NO: 96329 - DNA, 819 bp, Artificial Sequence
  Description of Artificial Sequence: Synthetic coding sequence
atggacgagaagaccaagaaggccgaggagatggccctgagcctgaccagagccgtggccggcggcgacgagcaggtggccatgaagtgcgccatctggctggccgagcagagagtgcccctgagcgtgcagctgaagcccgaggtgagccccacccaggacatcagactgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgaggcctaccaggtgcccgccagctaccagcccgacgaggaggagagagccagactggccggcgaggaggaggccctgagacagtaccagcagggcgtgcccgccggccaccacccccagcagcccggcggcggcggcctgctgcccctgcactag

SEQ ID NO: 96330 - DNA, 354 bp, Artificial Sequence
  Description of Artificial Sequence: Synthetic coding sequence
atggacgagaagaccaagaaggccgaggagatggccctgagcctgaccagagccgtggccggcggcgacgagcaggtggccatgaagtgcgccatctggctggccgagcagagagtgcccctgagcgtgcagctgaagcccgaggtgagccccacccaggacatcagactgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccactag

SEQ ID NO: 96331 - DNA, 768 bp, Artificial Sequence
  Description of Artificial Sequence: Synthetic coding sequence
tgagagatggccctgagcctgaccagagccgtggccggcggcgacgagcaggtggccatgaagtgcgccatctggctggccgagcagagagtgcccctgagcgtgcagctgaagcccgaggtgagccccacccaggacatcagaagcagaggcgagaagaccgaggaggtgggcgaggtgagagaggtgcccgaccacggcggccccagagtgctgcccagagtggacagcaagagcagcgtggagcccctggagggccccaactggctgtgggtgagcgtggaggacgcccagatgcacaccgtgaccatctggctgaccgtgagacccgacatgaccgtggccagcctgaaggacatggtgttcctggactacggcttcccccccgtgctgcagcagtgggtgatcggccagagactggccagagaccaggagaccctgcacagccacggcgtgagacagaacggcgacagcgcctacctgtacctgctgagcgccagaaacaccagcctgaacccccaggagctgcagagagagagacagctgagaatgctggaggacctgggcttcaaggacctgaccctgcagcccagaggccccctggagcccggcccccccaagcccggcgtgccccaggagcccggcagaggccagcccgacgccgtgcccgagcccccccccgtgggctggcagtgccccggctgcaccttcatcaacaagcccaccagacccggctgcgagatgtgctgcagagccagacccgagtag

SEQ ID NO: 96332 - DNA, 819 bp, Artificial Sequence; identical to SEQ ID NO: 96329
  Description of Artificial Sequence: Synthetic coding sequence

SEQ ID NO: 96333 - DNA, 4830 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaaagaagagatggagaagcctgggcagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaagggctacaccctgatccccagcgccaagagcgacaacctgagcgacagcagccacagcgagatcagcagcagaagcagcatcgtgagcaactgcagcgtggacagcatgagcgccgccctgcaggacgagagatgcagcagccaggccctggccgtgcccgagagcaccggcgccctggagaagaccgagcacgccagcggcatcggcgaccacagccagcacggccccggctggaccctgctgaagcccagcctgatcaagtgcctggccgtgagcagcagcgtgagcaacgaggagatcagccaggagcacatcatcatcgaggccgccgacagcggcagaggcagctggaccagctgcagcagcagcagccacgacaacttccagagcctgcccaaccccaagagctgggacttcctgaacagctacagacacacccacctggacgaccccatcgccgaggtggagcccaccgacagcgagccctacagctgcagcaagagctgcagcagaacctgcggccagtgcaagggcagcctggagagaaagagctggaccagcagcagcagcctgagcgacacctacgagcccaactacggcaccgtgaagcagagagtgctggagagcacccccgccgagagcagcgagggcctggaccccaaggacgccaccgaccccgtgtacaagaccgtgaccagcagcaccgagaagggcctgatcgtgtactgcgtgaccagccccaagaaggacgacagatacagagagcccccccccaccccccccggctacctgggcatcagcctggccgacctgaaggagggcccccacacccacctgaagccccccgactacagcgtggccgtgcagagaagcaagatgatgcacaacagcctgagcagactgccccccgccagcctgagcagcaacctggtggcctgcgtgcccagcaagatcgtgacccagccccagagacacaacctgcagcccttccaccccaagctgggcgacgtgaccgacgccgacagcgaggccgacgagaacgagcaggtgagcgccgtgtag

SEQ ID NO: 96334 - DNA, 4530 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgccgtgggcttctactacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaaagaagagatggagaagcctgggcagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaagggctacaccctgatccccagcgccaagagcgacaacctgagcgacagcagccacagcgagatcagcagcagaagcagcatcgtgagcaactgcagcgtggacagcatgagcgccgccctgcaggacgagagatgcagcagccaggccctggccgtgcccgagagcaccggcgccctggagaagaccgagcacgccagcggcatcggcgaccacagccagcacggccccggctggaccctgctgaagcccagcctgatcaagtgcctggccgtgagcagcagcgtgagcaacgaggagatcagccaggagcacatcatcatcgaggccgccgacagcggcagaggcagctggaccagctgcagcagcagcagccacgacaacttccagagcctgcccaaccccaagagctgggacttcctgaacagctacagacacacccacctggacgaccccatcgccgaggtggagcccaccgacagcgagccctacagctgcagcaagagctgcagcagaacctgcggccagtgcaagggcagcctggagagaaagagctggaccagcagcagcagcctgagcgacacctacgagcccaactacggcaccgtgaagcagagagtgctggagagcacccccgccgagagcagcgagggcctggaccccaaggacgccaccgaccccgtgtacaagaccgtgaccagcagcaccgagaagggcctgatcgagaacgagcaggtgagcgccgtgtag

SEQ ID NO: 96335 - DNA, 4530 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgccaagggcttcaagaacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaaagaagagatggagaagcctgggcagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaagggctacaccctgatccccagcgccaagagcgacaacctgagcgacagcagccacagcgagatcagcagcagaagcagcatcgtgagcaactgcagcgtggacagcatgagcgccgccctgcaggacgagagatgcagcagccaggccctggccgtgcccgagagcaccggcgccctggagaagaccgagcacgccagcggcatcggcgaccacagccagcacggccccggctggaccctgctgaagcccagcctgatcaagtgcctggccgtgagcagcagcgtgagcaacgaggagatcagccaggagcacatcatcatcgaggccgccgacagcggcagaggcagctggaccagctgcagcagcagcagccacgacaacttccagagcctgcccaaccccaagagctgggacttcctgaacagctacagacacacccacctggacgaccccatcgccgaggtggagcccaccgacagcgagccctacagctgcagcaagagctgcagcagaacctgcggccagtgcaagggcagcctggagagaaagagctggaccagcagcagcagcctgagcgacacctacgagcccaactacggcaccgtgaagcagagagtgctggagagcacccccgccgagagcagcgagggcctggaccccaaggacgccaccgaccccgtgtacaagaccgtgaccagcagcaccgagaagggcctgatcggcaagaagcagaccagctacttctag

SEQ ID NO: 96336 - DNA, 4515 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaaagaagagatggagaagcctgggcagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaagggctacaccctgatccccagcgccaagagcgacaacctgagcgacagcagccacagcgagatcagcagcagaagcagcatcgtgagcaactgcagcgtggacagcatgagcgccgccctgcaggacgagagatgcagcagccaggccctggccgtgcccgagagcaccggcgccctggagaagaccgagcacgccagcggcatcggcgaccacagccagcacggccccggctggaccctgctgaagcccagcctgatcaagtgcctggccgtgagcagcagcgtgagcaacgaggagatcagccaggagcacatcatcatcgaggccgccgacagcggcagaggcagctggaccagctgcagcagcagcagccacgacaacttccagagcctgcccaaccccaagagctgggacttcctgaacagctacagacacacccacctggacgaccccatcgccgaggtggagcccaccgacagcgagccctacagctgcagcaagagctgcagcagaacctgcggccagtgcaagggcagcctggagagaaagagctggaccagcagcagcagcctgagcgacacctacgagcccaactacggcaccgtgaagcagagagtgctggagagcacccccgccgagagcagcgagggcctggaccccaaggacgccaccgaccccgtgtacaagaccgtgaccagcagcaccgagaagggcctgatcgagaacgagcaggtgagcgccgtgtag

SEQ ID NO: 96337 - DNA, 4806 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaagggctacaccctgatccccagcgccaagagcgacaacctgagcgacagcagccacagcgagatcagcagcagaagcagcatcgtgagcaactgcagcgtggacagcatgagcgccgccctgcaggacgagagatgcagcagccaggccctggccgtgcccgagagcaccggcgccctggagaagaccgagcacgccagcggcatcggcgaccacagccagcacggccccggctggaccctgctgaagcccagcctgatcaagtgcctggccgtgagcagcagcgtgagcaacgaggagatcagccaggagcacatcatcatcgaggccgccgacagcggcagaggcagctggaccagctgcagcagcagcagccacgacaacttccagagcctgcccaaccccaagagctgggacttcctgaacagctacagacacacccacctggacgaccccatcgccgaggtggagcccaccgacagcgagccctacagctgcagcaagagctgcagcagaacctgcggccagtgcaagggcagcctggagagaaagagctggaccagcagcagcagcctgagcgacacctacgagcccaactacggcaccgtgaagcagagagtgctggagagcacccccgccgagagcagcgagggcctggaccccaaggacgccaccgaccccgtgtacaagaccgtgaccagcagcaccgagaagggcctgatcgtgtactgcgtgaccagccccaagaaggacgacagatacagagagcccccccccaccccccccggctacctgggcatcagcctggccgacctgaaggagggcccccacacccacctgaagccccccgactacagcgtggccgtgcagagaagcaagatgatgcacaacagcctgagcagactgccccccgccagcctgagcagcaacctggtggcctgcgtgcccagcaagatcgtgacccagccccagagacacaacctgcagcccttccaccccaagctgggcgacgtgaccgacgccgacagcgaggccgacgagaacgagcaggtgagcgccgtgtag

SEQ ID NO: 96338 - DNA, 3615 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgatgtag

SEQ ID NO: 96339 - DNA, 4176 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatactacctgaagaacaacatggagaccgagaccctgtgcagcgacgaggacgcccaggagctggtgaaggagagccagctgagcatgctgcagctgagcaccatcgaggtggccacccagctgagcatgagagacttcgacctgttcagaaacatcgagcccaccgagtacatcgacgacctgttcaagctgaacagcaagaccggcaacacccacctgaagagattcgaggacatcgtgaaccaggagaccttctgggtggccagcgagatcctgaccgaggccaaccagctgaagagaatgaagatcatcaagcacttcatcaagatcgccctgcactgcagagagtgcaagaacttcaacagcatgttcgccatcatcagcggcctgaacctggccagcgtggccagactgagaggcacctgggagaagctgcccagcaagtacgagaagcacctgcaggacctgcaggacatcttcgaccccagcagaaacatggccaagtacagaaacatcctgagcagccagagcatgcagccccccatcatccccctgttccccgtggtgaagaaggacatgaccttcctgcacgagggcaacgacagcaaggtggacggcctggtgaacttcgagaagctgagaatgatcagcaaggagatcagacaggtggtgagaatgaccagcgccaacatggaccccgccatgatgttcagacagagaagcctgagccagggcagcaccaacagcaacatgctggacgtgcagggcggcgcccacaagaagagagccagaagaagcagcctgctgaacgccaagaagctgtacgaggacgcccagatggccagaaaggtgaagcagtacctgagcagcctggacgtggagaccgacgaggagaagttccagatgatgagcctgcagtgggagcccgcctacggcaccctgaccaagaacctgagcgagaagagaagcgccaagagcagcgagatgagccccgtgcccatgagaagcgccggccagaccaccaaggcccacctgcaccagccccacagagtgagccaggtgctgcaggtgcccgccgtgaacctgcaccccatcagaaagaagggccagaccaaggaccccgccctgaacaccagcctgccccagaaggtgctgggcaccaccgaggagatcagcggcaagaagcacaccgaggacaccatcagcgtggccagcagcctgcacagcagcccccccgccagcccccagggcagcccccacaaggtgggcagcatcatcagcgaccacagcagcaagatcagcggccagagctgccccggcatcggcggcgcctacctgcagaagaagatcctgcagatcaccagaagcaccgccaagagaaccgacagcaccgagaaggccaccgaggagaacagagacagaaccagctgcgagaacaccaccagaaagagaatgaccagccccttcagaagactgagagagagaatgctgagcagagagagactggtgaacagccagaaggaggacaccgaccacaaccaggccaccgagagctgcgagaaggtgaaggacgtgggcagcaacatcaaggacgagaagggcagcgccatcttcaacagcaacagccagggcaacagcaacaccctgaactgcttctacaccagattcaagagcaagagaagaaagaccctgtag

SEQ ID NO: 96340 - DNA, 2484 bp, Artificial Sequence
  Description of Artificial Sequence: Synthetic coding sequence
atgaacagccccgtggaccccggcgccagacaggccctgagaaagaagccccccgagagaacccccgaggacctgaacaccatctacagctacctgcacggcatggagatcctgagcaacctgagagagcaccagctgagactgatgagcgccagagccagatacgagagatacagcggcaaccaggtgctgttctgcagcgagaccatcgccagatgctggtacatcctgctgagcggcagcgtgctggtgaagggcagcatggtgctgcccccctgcagcttcggcaagcagttcggcggcaagagaggctgcgactgcctggtgctggagcccagcgagatgatcgtggtggagaacgccaaggacaacgaggacagcatcctgcagagagagatccccgccagacagagcagaagaagattcagaaagatcaactacaagggcgagagacagaccatcaccgacgacgtggaggtgaacagctacctgagcctgcccgccgacctgaccaagatgcacctgaccgagaacccccacccccaggtgacccacgtgagcagcagccagagcggctgcagcatcgccagcgacagcggcagcagcagcctgagcgacatctaccaggccaccgagagcgaggtgggcgacgtggacctgaccagactgcccgagggccccgtggacagcgaggacgacgaggaggaggacgaggagatcgacagaaccgaccccctgcagggcagagacctggtgagagagtgcctggagaaggagcccgccgacaagaccgacgacgacatcgagcagctgctggagttcatgcaccagctgcccgccttcgccaacatgaccatgagcgtgagaagagagctgtgcagcgtgatgatcttcgaggtggtggagcaggccggcgccatcatcctggaggacggccaggagctggacagctggtacgtgatcctgaacggcaccgtggagatcagccaccccgacggcaaggtggagaacctgttcatgggcaacagcttcggcatcacccccaccctggacaagcagtacatgcacggcatcgtgagaaccaaggtggacgactgccagttcgtgtgcatcgcccagcaggactactggagaatcctgaaccacgtggagaagaacacccacaaggtggaggaggagggcgagatcgtgatggtgcacgagcacagagagctggacagaagcggcaccagaaagggccacatcgtgatcaaggccacccccgagagactgatcatgcacctgatcgaggagcacagcatcgtggaccccacctacatcgaggacttcctgctgacctacagaaccttcctggagagccccctggacgtgggcatcaagctgctggagtggttcaagatcgacagcctgagagacaaggtgaccagaatcgtgctgctgtgggtgaacaaccacttcaacgacttcgagggcgaccccgccatgaccagattcctggaggagttcgagaagaacctggaggacaccaagatgaacggccacctgagactgctgaacatcgcctgcgccgccaaggccaagtggagacaggtggtgctgcagaaggccagcagagagagccccctgcagttcagcctgaacggcggcagcgagaagggcttcggcatcttcgtggagggcgtggagcccggcagcaaggccgccgacagcggcctgaagagaggcgaccagatcatggaggtgaacggccagaacttcgagaacatcaccttcatgaaggccgtggagatcctgagaaacaacacccacctggccctgaccgtgaagaccaacatcttcgtgttcaaggagctgctgttcagaaccgagcaggagaagagcggcgtgccccacatccccaagatcgccgagaagaagagcaacagacacagcatccagcacgtgcccggcgacatcgagcagaccagccaggagaagggcagcaagaaggtgaaggccaacaccgtgagcggcggcagaaacaagatcagaaagatcctggacaagaccagattcagcatcctgccccccaagctgttcagcgacggcggcctgagccagagccaggacgacagcatcgtgggcaccagacactgcagacacagcctggccatcatgcccatccccggcaccctgagcagcagcagccccgacctgctgcagcccaccaccagcatgctggacttcagcaaccccagcgacatccccgaccaggtgatcagagtgttcaaggtggaccagcagagctgctacatcatcatcagcaaggacaccaccgccaaggaggtggtgttccacgccgtgcacgagttcggcctgaccggcgccagcgacacctacagcctgtgcgaggtgagcgtgacccccgagggcgtgatcaagcagagaagactgcccgaccagttcagcaagctggccgacagaatccagctgaacggcagatag

SEQ ID NO: 96341 - DNA, 1551 bp, Artificial Sequence
  Description of Artificial Sequence: Synthetic coding sequence
atggccgacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggccgaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96342 - DNA, 1827 bp, Artificial Sequence
  Description of Artificial Sequence: Synthetic coding sequence
atggccgacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccacgagggcagaagcgccgtggaccaggccggcggcgcccagatcgtgatcgaccacctgagaagcctgtgcagcatcaccgaccccgccaacgagaagctgctgaccgtgttctgcggcatgctgatgaactacagcaacgagaacgacagcctgcaggcccagctgatcaacatgggcgtgatccccaccctggtgaagctgctgggcatccactgccagaacgccgccctgaccgagatgtgcctggtggccttcggcaacctggccgagctggagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggccgaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96343 - DNA, 1680 bp, Artificial Sequence
  Description of Artificial Sequence: Synthetic coding sequence
atggccgacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccacagcctgcaggcccagctgatcaacatgggcgtgatccccaccctggtgaagctgctgggcatccactgccagaacgccgccctgaccgagatgtgcctggtggccttcggcaacctggccgagctggagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggccgaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96344 - DNA, 1677 bp, Artificial Sequence
  Description of Artificial Sequence: Synthetic coding sequence
atggacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccacagcctgcaggcccagctgatcaacatgggcgtgatccccaccctggtgaagctgctgggcatccactgccagaacgccgccctgaccgagatgtgcctggtggccttcggcaacctggccgagctggagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggccgaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96345 - DNA, 1824 bp, Artificial Sequence
  Description of Artificial Sequence: Synthetic coding sequence
atggacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccacgagggcagaagcgccgtggaccaggccggcggcgcccagatcgtgatcgaccacctgagaagcctgtgcagcatcaccgaccccgccaacgagaagctgctgaccgtgttctgcggcatgctgatgaactacagcaacgagaacgacagcctgcaggcccagctgatcaacatgggcgtgatccccaccctggtgaagctgctgggcatccactgccagaacgccgccctgaccgagatgtgcctggtggccttcggcaacctggccgagctggagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggccgaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96346 - DNA, 1824 bp, Artificial Sequence
  Description of Artificial Sequence: Synthetic coding sequence
atggccgacaacctgagcgacaccctgaagaagctgaagatcaccgccgtggacaagaccgaggacagcctggagggctgcctggactgcctgctgcaggccctggcccagaacaacaccgagaccagcgagaagatccaggccagcggcatcctgcagctgttcgccagcctgctgaccccccagagcagctgcaaggccaaggtggccaacatcatcgccgaggtggccaagaacgagttcatgagaatcccctgcgtggacgccggcctgatcagccccctggtgcagctgctgaacagcaaggaccaggaggtgctgctgcagaccggcagagccctgggcaacatctgctacgacagccacgagggcagaagcgccgtggaccaggccggcggcgcccagatcgtgatcgaccacctgagaagcctgtgcagcatcaccgaccccgccaacgagaagctgctgaccgtgttctgcggcatgctgatgaactacagcaacgagaacgacagcctgcaggcccagctgatcaacatgggcgtgatccccaccctggtgaagctgctgggcatccactgccagaacgccgccctgaccgagatgtgcctggtggccttcggcaacctggccgagctggagagcagcaaggagcagttcgccagcaccaacatcgccgaggagctggtgaagctgttcaagaagcagatcgagcacgacaagagagagatgatcttcgaggtgctggcccccctggccgagaacgacgccatcaagctgcagctggtggaggccggcctggtggagtgcctgctggagatcgtgcagcagaaggtggacagcgacaaggaggacgacatcaccgagctgaagaccggcagcgacctgatggtgctgctgctgctgggcgacgagagcatgcagaagctgttcgagggcggcaagggcagcgtgttccagagagtgctgagctggatccccagcaacaaccaccagctgcagctggccggcgccctggccatcgccaacttcgccagaaacgacgccaactgcatccacatggtggacaacggcatcgtggagaagctgatggacctgctggacagacacgtggaggacggcaacgtgaccgtgcagcacgccgccctgagcgccctgagaaacctggccatccccgtgatcaacaaggccaagatgctgagcgccggcgtgaccgaggccgtgctgaagttcctgaagagcgagatgccccccgtgcagttcaagctgctgggcaccctgagaatgctgatcgacgcccaggaggccgccgagcagctgggcaagaacgtgaagctggtggagagactggtggagtggtgcgaggccaaggaccacgccggcgtgatgggcgagagcaacagactgctgagcgccctgatcagacacagcaagagcaaggacgtgatcaagaccatcgtgcagagcggcggcatcaagcacctggtgaccatggccaccagcgagcacgtgatcatgcagaacgaggccctggtggccctggccctgatcgccgccctggagctgggcaccgccgagaaggacctggagagcgccaagctggtgcagatcctgcacagactgctggccgacgagagaagcgcccccgagatcaagtacaacagcatggtgctgatctgcgccctgatgggcagcgagtgcctgcacaaggaggtgcaggacctggccttcctggacgtggtgagcaagctgagaagccacgagaacaagagcgtggcccagcaggccagcctgaccgagcagagactgaccgtggagagctag

SEQ ID NO: 96347 - DNA, 555 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggccagacagtggaacaactgcgccttcctggagagcagcgccaagagcaagatcaacgtgaacgagatcttctacgacctggtgagacagatcaacagaaagacccccgtgcccggcaaggccagaaagaagagcagctgccagctgctgtag

SEQ ID NO: 96348 - DNA, 555 bp, Artificial Sequence; identical to SEQ ID NO: 96347
  Description of Artificial Sequence: Synthetic coding sequence

SEQ ID NO: 96349 - DNA, 357 bp, Artificial Sequence
  Description of Artificial Sequence: Synthetic coding sequence
atgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggccagacagtggaacaactgcgccttcctggagagcagcgccaagagcaagatcaacgtgaacgagatcttctacgacctggtgagacagatcaacagaaagacccccgtgcccggcaaggccagaaagaagagcagctgccagctgctgtag

SEQ ID NO: 96350 - DNA, 555 bp, Artificial Sequence; identical to SEQ ID NO: 96347
  Description of Artificial Sequence: Synthetic coding sequence

SEQ ID NO: 96351 - DNA, 99 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtactag

SEQ ID NO: 96352 - DNA, 429 bp, Artificial Sequence
  Description of Artificial Sequence: Synthetic coding sequence
atgagagagtacaagctggtggtgctgggcagcggcggcgtgggcaagagcgccctggagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggccagacagtggaacaactgcgccttcctggagagcagcgccaagagcaagatcaacgtgaacgagatcttctacgacctggtgagacagatcaacagaaagacccccgtgcccggcaaggccagaaagaagagcagctgccagctgctgtag

SEQ ID NO: 96353 - DNA, 384 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggctag

SEQ ID NO: 96354 - DNA, 429 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggacaacggcaccaccgtgcacagctag

SEQ ID NO: 96355 - DNA, 147 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcctag

SEQ ID NO: 96356 - DNA, 36 bp, Artificial Sequence
  Description of Artificial Sequence: Synthetic coding sequence
atgagagagtacaagctggtggtgctgggcagctag

SEQ ID NO: 96357 - DNA, 264 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagtag

SEQ ID NO: 96358 - DNA, 555 bp, Artificial Sequence; identical to SEQ ID NO: 96347
  Description of Artificial Sequence: Synthetic coding sequence

SEQ ID NO: 96359 - DNA, 306 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgtag

SEQ ID NO: 96360 - DNA, 162 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctgtag

SEQ ID NO: 96361 - DNA, 429 bp, Artificial Sequence; identical to SEQ ID NO: 96352
  Description of Artificial Sequence: Synthetic coding sequence

SEQ ID NO: 96362 - DNA, 498 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaaggagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggccagacagtggaacaactgcgccttcctggagagcagcgccaagagcaagatcaacgtgaacgagatcttctacgacctggtgagacagatcaacagaaagacccccgtgcccggcaaggccagaaagaagagcagctgccagctgctgtag

SEQ ID NO: 96363 - DNA, 420 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggacgagagagtggtgggcaaggagcagggccagaacctggccagacagtggaactag

SEQ ID NO: 96364 - DNA, 282 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgtag

SEQ ID NO: 96365 - DNA, 36 bp, Artificial Sequence; identical to SEQ ID NO: 96356
  Description of Artificial Sequence: Synthetic coding sequence

SEQ ID NO: 96366 - DNA, 297 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagtag

SEQ ID NO: 96367 - DNA, 414 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgtgcccatgatcctggtgggcaacaagtgcgacctggaggacgagagagtggtgggcaaggagcagggccagaacctggccagacagtggaacaactgcgccttcctggagagcagcgccaagagcaagatcaacgtgaacgagatcttctacgacctggtgagacagatcaacagaaagacccccgtgcccggcaaggccagaaagaagagcagctgccagctgctgtag

SEQ ID NO: 96368 - DNA, 357 bp, Artificial Sequence; identical to SEQ ID NO: 96349
  Description of Artificial Sequence: Synthetic coding sequence

SEQ ID NO: 96369 - DNA, 369 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgacgacgtgcccatgatcctggtgggcaacaagtgcgacctggaggactag

SEQ ID NO: 96370 - DNA, 258 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggacgcccagcagtgcatgctggagatcctggacaccgccggcaccgagcagttcaccgccatgagagacctgtacatgaagaacggccagggcttcgccctggtgtacagcatcacctag

SEQ ID NO: 96371 - DNA, 552 bp, Artificial Sequence
  Description of Artificial Sequence: Synthetic coding sequence
atgagagagtacaaggtggtggtgctgggcagcggcggcgtgggcaagagcgccctgaccgtgcagttcgtgaccggcaccttcatcgagaagtacgaccccaccatcgaggacttctacagaaaggagatcgaggtggacagcagccccagcgtgctggagatcctggacaccgccggcaccgagcagttcgccagcatgagagacctgtacatcaagaacggccagggcttcatcctggtgtacagcctggtgaaccagcagagcttccaggacatcaagcccatgagagaccagatcatcagagtgaagagatacgagaaggtgcccgtgatcctggtgggcaacaaggtggacctggagagcgagagagaggtgagcagcagcgagggcagagccctggccgaggagtggggctgccccttcatggagaccagcgccaagagcaagaccatggtggacgagctgttcgccgagatcgtgagacagatgaactacgccgcccagcccgacaaggacgacccctgctgcagcgcctgcaacatccagtag

SEQ ID NO: 96372 - DNA, 1671 bp, Artificial Sequence
  Description of Artificial Sequence: Synthetic coding sequence
atgaacgagggcgcccccggcgacagcgacctggagaccgaggccagagtgccctggagcatcatgggccactgcctgagaaccggccaggccagaatgagcgccacccccacccccgccggcgagggcgccagaagagacgagctgttcggcatcctgcagatcctgcaccagtgcatcctgagcagcggcgacgccttcgtgctgaccggcgtgtgctgcagctggagacagaacggcaagcccccctacagccagaaggaggacaaggaggtgcagaccggctacatgaacgcccagatcgagatcatcccctgcaagatctgcggcgacaagagcagcggcatccactacggcgtgatcacctgcgagggctgcaagggcttcttcagaagaagccagcagagcaacgccacctacagctgccccagacagaagaactgcctgatcgacagaaccagcagaaacagatgccagcactgcagactgcagaagtgcctggccgtgggcatgagcagagacgccgtgaagttcggcagaatgagcaagaagcagagagacagcctgtacgccgaggtgcagaagcacagaatgcagcagcagcagagagaccaccagcagcagcccggcgaggccgagcccctgacccccacctacaacatcagcgccaacggcctgaccgagctgcacgacgacctgagcaactacatcgacggccacacccccgagggcagcaaggccgacagcgccgtgagcagcttctacctggacatccagcccagccccgaccagagcggcctggacatcaacggcatcaagcccgagcccatctgcgactacacccccgccagcggcttcttcccctactgcagcttcaccaacggcgagaccagccccaccgtgagcatggccgagctggagcacctggcccagaacatcagcaagagccacctggagacctgccagtacctgagagaggagctgcagcagatcacctggcagaccttcctgcaggaggagatcgagaactaccagaacaagcagagagaggtgatgtggcagctgtgcgccatcaagatcaccgaggccatccagtacgtggtggagttcgccaagagaatcgacggcttcatggagctgtgccagaacgaccagatcgtgctgctgaaggccggcagcctggaggtggtgttcatcagaatgtgcagagccttcgacagccagaacaacaccgtgtacttcgacggcaagtacgccagccccgacgtgttcaagagcctgggctgcgaggacttcatcagcttcgtgttcgagttcggcaagagcctgtgcagcatgcacctgaccgaggacgagatcgccctgttcagcgccttcgtgctgatgagcgccgacagaagctggctgcaggagaaggtgaagatcgagaagctgcagcagaagatccagctggccctgcagcacgtgctgcagaagaaccacagagaggacggcatcctgaccaagctgatctgcaaggtgagcaccctgagagccctgtgcggcagacacaccgagaagctgatggccttcaaggccatctaccccgacatcgtgagactgcacttcccccccctgtacaaggagctgttcaccagcgagttcgagcccgccatgcagatcgacggctag

SEQ ID NO: 96373 - DNA, 1647 bp, Artificial Sequence
  Description of Artificial Sequence: Synthetic coding sequence
atgaacgagggcgcccccggcgacagcgacctggagaccgaggccagagtgccctggagcatcatgggccactgcctgagaaccggccaggccagaatgagcgccacccccacccccgccggcgagggcgccagaagcagcagcacctgcagcagcctgagcagactgttctggagccagctggagcacatcaactgggacggcgccaccgccaagaacttcatcaacctgagagagttcttcagcttcctgctgcccgccctgagaaaggcccagatcgagatcatcccctgcaagatctgcggcgacaagagcagcggcatccactacggcgtgatcacctgcgagggctgcaagggcttcttcagaagaagccagcagagcaacgccacctacagctgccccagacagaagaactgcctgatcgacagaaccagcagaaacagatgccagcactgcagactgcagaagtgcctggccgtgggcatgagcagagacgccgtgaagttcggcagaatgagcaagaagcagagagacagcctgtacgccgaggtgcagaagcacagaatgcagcagcagcagagagaccaccagcagcagcccggcgaggccgagcccctgacccccacctacaacatcagcgccaacggcctgaccgagctgcacgacgacctgagcaactacatcgacggccacacccccgagggcagcaaggccgacagcgccgtgagcagcttctacctggacatccagcccagccccgaccagagcggcctggacatcaacggcatcaagcccgagcccatctgcgactacacccccgccagcggcttcttcccctactgcagcttcaccaacggcgagaccagccccaccgtgagcatggccgagctggagcacctggcccagaacatcagcaagagccacctggagacctgccagtacctgagagaggagctgcagcagatcacctggcagaccttcctgcaggaggagatcgagaactaccagaacaagcagagagaggtgatgtggcagctgtgcgccatcaagatcaccgaggccatccagtacgtggtggagttcgccaagagaatcgacggcttcatggagctgtgccagaacgaccagatcgtgctgctgaaggccggcagcctggaggtggtgttcatcagaatgtgcagagccttcgacagccagaacaacaccgtgtacttcgacggcaagtacgccagccccgacgtgttcaagagcctgggctgcgaggacttcatcagcttcgtgttcgagttcggcaagagcctgtgcagcatgcacctgaccgaggacgagatcgccctgttcagcgccttcgtgctgatgagcgccgacagaagctggctgcaggagaaggtgaagatcgagaagctgcagcagaagatccagctggccctgcagcacgtgctgcagaagaaccacagagaggacggcatcctgaccaagctgatctgcaaggtgagcaccctgagagccctgtgcggcagacacaccgagaagctgatggccttcaaggccatctaccccgacatcgtgagactgcacttcccccccctgtacaaggagctgttcaccagcgagttcgagcccgccatgcagatcgacggctag

SEQ ID NO: 96374 - DNA, 1572 bp, Artificial Sequence
  Description of Artificial Sequence: Synthetic coding sequence
atggagagcgcccccgccgcccccgaccccgccgccagcgagcccggcagcagcggcgccgacgccgccgccggcagcagagagacccccctgaaccaggagagcgccagaaagagcgagccccccgcccccgtgagaagacagagctacagcagcaccagcagaggcatcagcgtgaccaagaagacccacaccagccagatcgagatcatcccctgcaagatctgcggcgacaagagcagcggcatccactacggcgtgatcacctgcgagggctgcaagggcttcttcagaagaagccagcagagcaacgccacctacagctgccccagacagaagaactgcctgatcgacagaaccagcagaaacagatgccagcactgcagactgcagaagtgcctggccgtgggcatgagcagagacgccgtgaagttcggcagaatgagcaagaagcagagagacagcctgtacgccgaggtgcagaagcacagaatgcagcagcagcagagagaccaccagcagcagcccggcgaggccgagcccctgacccccacctacaacatcagcgccaacggcctgaccgagctgcacgacgacctgagcaactacatcgacggccacacccccgagggcagcaaggccgacagcgccgtgagcagcttctacctggacatccagcccagccccgaccagagcggcctggacatcaacggcatcaagcccgagcccatctgcgactacacccccgccagcggcttcttcccctactgcagcttcaccaacggcgagaccagccccaccgtgagcatggccgagctggagcacctggcccagaacatcagcaagagccacctggagacctgccagtacctgagagaggagctgcagcagatcacctggcagaccttcctgcaggaggagatcgagaactaccagaacaagcagagagaggtgatgtggcagctgtgcgccatcaagatcaccgaggccatccagtacgtggtggagttcgccaagagaatcgacggcttcatggagctgtgccagaacgaccagatcgtgctgctgaaggccggcagcctggaggtggtgttcatcagaatgtgcagagccttcgacagccagaacaacaccgtgtacttcgacggcaagtacgccagccccgacgtgttcaagagcctgggctgcgaggacttcatcagcttcgtgttcgagttcggcaagagcctgtgcagcatgcacctgaccgaggacgagatcgccctgttcagcgccttcgtgctgatgagcgccgacagaagctggctgcaggagaaggtgaagatcgagaagctgcagcagaagatccagctggccctgcagcacgtgctgcagaagaaccacagagaggacggcatcctgaccaagctgatctgcaaggtgagcaccctgagagccctgtgcggcagacacaccgagaagctgatggccttcaaggccatctaccccgacatcgtgagactgcacttcccccccctgtacaaggagctgttcaccagcgagttcgagcccgccatgcagatcgacggctag

SEQ ID NO: 96375 - DNA, 1407 bp, Artificial Sequence
  Description of Artificial Sequence: Synthetic coding sequence
atgatgtacttcgtgatcgccgccatgaaggcccagatcgagatcatcccctgcaagatctgcggcgacaagagcagcggcatccactacggcgtgatcacctgcgagggctgcaagggcttcttcagaagaagccagcagagcaacgccacctacagctgccccagacagaagaactgcctgatcgacagaaccagcagaaacagatgccagcactgcagactgcagaagtgcctggccgtgggcatgagcagagacgccgtgaagttcggcagaatgagcaagaagcagagagacagcctgtacgccgaggtgcagaagcacagaatgcagcagcagcagagagaccaccagcagcagcccggcgaggccgagcccctgacccccacctacaacatcagcgccaacggcctgaccgagctgcacgacgacctgagcaactacatcgacggccacacccccgagggcagcaaggccgacagcgccgtgagcagcttctacctggacatccagcccagccccgaccagagcggcctggacatcaacggcatcaagcccgagcccatctgcgactacacccccgccagcggcttcttcccctactgcagcttcaccaacggcgagaccagccccaccgtgagcatggccgagctggagcacctggcccagaacatcagcaagagccacctggagacctgccagtacctgagagaggagctgcagcagatcacctggcagaccttcctgcaggaggagatcgagaactaccagaacaagcagagagaggtgatgtggcagctgtgcgccatcaagatcaccgaggccatccagtacgtggtggagttcgccaagagaatcgacggcttcatggagctgtgccagaacgaccagatcgtgctgctgaaggccggcagcctggaggtggtgttcatcagaatgtgcagagccttcgacagccagaacaacaccgtgtacttcgacggcaagtacgccagccccgacgtgttcaagagcctgggctgcgaggacttcatcagcttcgtgttcgagttcggcaagagcctgtgcagcatgcacctgaccgaggacgagatcgccctgttcagcgccttcgtgctgatgagcgccgacagaagctggctgcaggagaaggtgaagatcgagaagctgcagcagaagatccagctggccctgcagcacgtgctgcagaagaaccacagagaggacggcatcctgaccaagctgatctgcaaggtgagcaccctgagagccctgtgcggcagacacaccgagaagctgatggccttcaaggccatctaccccgacatcgtgagactgcacttcccccccctgtacaaggagctgttcaccagcgagttcgagcccgccatgcagatcgacggctag

SEQ ID NO: 96376 - DNA, 1557 bp, Artificial Sequence
  Description of Artificial Sequence: Synthetic coding sequence
atggacagagccccccagagacagcacagagccagcagagagctgctggccgccaagaagacccacaccagccagatcgaggtgatcccctgcaagatctgcggcgacaagagcagcggcatccactacggcgtgatcacctgcgagggctgcaagggcttcttcagaagaagccagagatgcaacgccgcctacagctgcaccagacagcagaactgccccatcgacagaaccagcagaaacagatgccagcactgcagactgcagaagtgcctggccctgggcatgagcagagacgccgtgaagttcggcagaatgagcaagaagcagagagacagcctgcacgccgaggtgcagaagcagctgcagcagagacagcagcagcagcaggagcccgtggtgaagaccccccccgccggcgcccagggcgccgacaccctgacctacaccctgggcctgcccgacggccagctgcccctgggcagcagccccgacctgcccgaggccagcgcctgcccccccggcctgctgaaggccagcggcagcggccccagctacagcaacaacctggccaaggccggcctgaacggcgccagctgccacctggagtacagccccgagagaggcaaggccgagggcagagagagcttctacagcaccggcagccagctgacccccgacagatgcggcctgagattcgaggagcacagacaccccggcctgggcgagctgggccagggccccgacagctacggcagccccagcttcagaagcacccccgaggccccctacgccagcctgaccgagatcgagcacctggtgcagagcgtgtgcaagagctacagagagacctgccagctgagactggaggacctgctgagacagagaagcaacatcttcagcagagaggaggtgaccggctaccagagaaagagcatgtgggagatgtgggagagatgcgcccaccacctgaccgaggccatccagtacgtggtggagttcgccaagagactgagcggcttcatggagctgtgccagaacgaccagatcgtgctgctgaaggccggcgccatggaggtggtgctggtgagaatgtgcagagcctacaacgccgacaacagaaccgtgttcttcgagggcaagtacggcggcatggagctgttcagagccctgggctgcagcgagctgatcagcagcatcttcgacttcagccacagcctgagcgccctgcacttcagcgaggacgagatcgccctgtacaccgccctggtgctgatcaacgcccacagacccggcctgcaggagaagagaaaggtggagcagctgcagtacaacctggagctggccttccaccaccacctgtgcaagacccacagacagagcatcctggccaagctgccccccaagggcaagctgagaagcctgtgcagccagcacgtggagagactgcagatcttccagcacctgcaccccatcgtggtgcaggccgccttcccccccctgtacaaggagctgttcagcaccgagaccgagagccccgtgggcctgagcaagtag

SEQ ID NO: 96377 - DNA, 1494 bp, Artificial Sequence
  Description of Artificial Sequence: Synthetic coding sequence
atgagaacccagatcgaggtgatcccctgcaagatctgcggcgacaagagcagcggcatccactacggcgtgatcacctgcgagggctgcaagggcttcttcagaagaagccagagatgcaacgccgcctacagctgcaccagacagcagaactgccccatcgacagaaccagcagaaacagatgccagcactgcagactgcagaagtgcctggccctgggcatgagcagagacgccgtgaagttcggcagaatgagcaagaagcagagagacagcctgcacgccgaggtgcagaagcagctgcagcagagacagcagcagcagcaggagcccgtggtgaagaccccccccgccggcgcccagggcgccgacaccctgacctacaccctgggcctgcccgacggccagctgcccctgggcagcagccccgacctgcccgaggccagcgcctgcccccccggcctgctgaaggccagcggcagcggccccagctacagcaacaacctggccaaggccggcctgaacggcgccagctgccacctggagtacagccccgagagaggcaaggccgagggcagagagagcttctacagcaccggcagccagctgacccccgacagatgcggcctgagattcgaggagcacagacaccccggcctgggcgagctgggccagggccccgacagctacggcagccccagcttcagaagcacccccgaggccccctacgccagcctgaccgagatcgagcacctggtgcagagcgtgtgcaagagctacagagagacctgccagctgagactggaggacctgctgagacagagaagcaacatcttcagcagagaggaggtgaccggctaccagagaaagagcatgtgggagatgtgggagagatgcgcccaccacctgaccgaggccatccagtacgtggtggagttcgccaagagactgagcggcttcatggagctgtgccagaacgaccagatcgtgctgctgaaggccggcgccatggaggtggtgctggtgagaatgtgcagagcctacaacgccgacaacagaaccgtgttcttcgagggcaagtacggcggcatggagctgttcagagccctgggctgcagcgagctgatcagcagcatcttcgacttcagccacagcctgagcgccctgcacttcagcgaggacgagatcgccctgtacaccgccctggtgctgatcaacgcccacagacccggcctgcaggagaagagaaaggtggagcagctgcagtacaacctggagctggccttccaccaccacctgtgcaagacccacagacagagcatcctggccaagctgccccccaagggcaagctgagaagcctgtgcagccagcacgtggagagactgcagatcttccagcacctgcaccccatcgtggtgcaggccgccttcccccccctgtacaaggagctgttcagcaccgagaccgagagccccgtgggcctgagcaagtag

SEQ ID NO: 96378 - DNA, 1719 bp, Artificial Sequence
  Description of Artificial Sequence: Synthetic coding sequence
atgtggggcaccggccccagcgccggcaaggacagaatgagcggcagaccctggccccacccctggagcaagagcggcacccccagcgagcaggacagaagagccaccggcctggtgagctgcgagcacggcggcggcaagttcgagggccagagccaccaggcccccggcccccccggcggcggcagaaccggctgcctggagctgctggccgccaagaagacccacaccagccagatcgaggtgatcccctgcaagatctgcggcgacaagagcagcggcatccactacggcgtgatcacctgcgagggctgcaagggcttcttcagaagaagccagagatgcaacgccgcctacagctgcaccagacagcagaactgccccatcgacagaaccagcagaaacagatgccagcactgcagactgcagaagtgcctggccctgggcatgagcagagacgccgtgaagttcggcagaatgagcaagaagcagagagacagcctgcacgccgaggtgcagaagcagctgcagcagagacagcagcagcagcaggagcccgtggtgaagaccccccccgccggcgcccagggcgccgacaccctgacctacaccctgggcctgcccgacggccagctgcccctgggcagcagccccgacctgcccgaggccagcgcctgcccccccggcctgctgaaggccagcggcagcggccccagctacagcaacaacctggccaaggccggcctgaacggcgccagctgccacctggagtacagccccgagagaggcaaggccgagggcagagagagcttctacagcaccggcagccagctgacccccgacagatgcggcctgagattcgaggagcacagacaccccggcctgggcgagctgggccagggccccgacagctacggcagccccagcttcagaagcacccccgaggccccctacgccagcctgaccgagatcgagcacctggtgcagagcgtgtgcaagagctacagagagacctgccagctgagactggaggacctgctgagacagagaagcaacatcttcagcagagaggaggtgaccggctaccagagaaagagcatgtgggagatgtgggagagatgcgcccaccacctgaccgaggccatccagtacgtggtggagttcgccaagagactgagcggcttcatggagctgtgccagaacgaccagatcgtgctgctgaaggccggcgccatggaggtggtgctggtgagaatgtgcagagcctacaacgccgacaacagaaccgtgttcttcgagggcaagtacggcggcatggagctgttcagagccctgggctgcagcgagctgatcagcagcatcttcgacttcagccacagcctgagcgccctgcacttcagcgaggacgagatcgccctgtacaccgccctggtgctgatcaacgcccacagacccggcctgcaggagaagagaaaggtggagcagctgcagtacaacctggagctggccttccaccaccacctgtgcaagacccacagacagagcatcctggccaagctgccccccaagggcaagctgagaagcctgtgcagccagcacgtggagagactgcagatcttccagcacctgcaccccatcgtggtgcaggccgccttcccccccctgtacaaggagctgttcagcaccgagaccgagagccccgtgggcctgagcaagtag

SEQ ID NO: 96379 - DNA, 2835 bp, Artificial Sequence
  Description of Artificial Sequence: Synthetic coding sequence
atgctggacagcttcagccaggagagcaccctgcccttcagagaggccagaaagagaaccagcttccagcccgtgcaggtgtggagaaacttcaccgccagccagaccaccgagagccccgcctgcagcggcgccagcctgggcgagatgaccgcctggaccatgggcgccagaggcctggacaagagaggcagcttcttcaagctgatcgacaccatcgccagcgagatcggcgagctgaagcaggagatggtgagaaccgacgtgaacctggagaacggcctggagcccgccgagacccacagcatggtgagacacaaggacggcggctacagcgaggaggaggacgtgaagacctgcgccagagacagcggctacgacagcctgagcaacagactgagcatcctggacagactgctgcacacccaccccatctggctgcagctgagcctgagcgaggaggaggccgccgaggtgctgcaggcccagccccccggcatcttcctggtgcacaagagcaccaagatgcagaagaaggtgctgagcctgagactgccctgcgagttcggcgcccccctgaaggagttcgccatcaaggagagcacctacaccttcagcctggagggcagcggcatcagcttcgccgacctgttcagactgatcgccttctactgcatcagcagagacgtgctgcccttcaccctgaagctgccctacgccatcagcaccgccaagagcgaggcccagctggaggagctggcccagatgggcctgaacttctggagcagccccgccgacagcaagccccccaacctgccccccccccacagacccctgagcagcgacggcgtgtgccccgccagcctgagacagctgtgcctgatcaacggcgtgcacagcatcaagaccagaacccccagcgagctggagtgcagccagaccaacggcgccctgtgcttcatcaaccccctgttcctgaaggtgcacagccaggacctgagcggcggcctgaagagacccagcaccagaacccccaacgccaacggcaccgagagaaccagaagccccccccccagaccccccccccccgccatcaacagcctgcacaccagccccagactggccagaaccgagacccagaccagcatgcccgagaccgtgaaccacaacaagcacggcaacgtggccctgcccggcaccaagcccacccccatccccccccccagactgaagaagcaggccagcttcctggaggccgagggcggcgccaagaccctgagcggcggcagacccggcgccggccccgagctggagctgggcaccgccggcagccccggcggcgccccccccgaggccgcccccggcgactgcaccagagcccccccccccagcagcgagagcagacccccctgccacggcggcagacagagactgagcgacatgagcatcagcaccagcagcagcgacagcctggagttcgacagaagcatgcccctgttcggctacgaggccgacaccaacagcagcctggaggactacgagggcgagagcgaccaggagaccatggccccccccatcaagagcaagaagaagagaagcagcagcttcgtgctgcccaagctggtgaagagccagctgcagaaggtgagcggcgtgttcagcagcttcatgacccccgagaagagaatggtgagaagaatcgccgagctgagcagagacaagtgcacctacttcggctgcctggtgcaggactacgtgagcttcctgcaggagaacaaggagtgccacgtgagcagcaccgacatgctgcagaccatcagacagttcatgacccaggtgaagaactacctgagccagagcagcgagctggacccccccatcgagagcctgatccccgaggaccagatcgacgtggtgctggagaaggccatgcacaagtgcatcctgaagcccctgaagggccacgtggaggccatgctgaaggacttccacatggccgacggcagctggaagcagctgaaggagaacctgcagctggtgagacagagaaacccccaggagctgggcgtgttcgcccccacccccgacttcgtggacgtggagaagatcaaggtgaagttcatgaccatgcagaagatgtacagccccgagaagaaggtgatgctgctgctgagagtgtgcaagctgatctacaccgtgatggagaacaacagcggcagaatgtacggcgccgacgacttcctgcccgtgctgacctacgtgatcgcccagtgcgacatgctggagctggacaccgagatcgagtacatgatggagctgctggaccccagcctgctgcacggcgagggcggctactacctgaccagcgcctacggcgccctgagcctgatcaagaacttccaggaggagcaggccgccagactgctgagcagcgagaccagagacaccctgagacagtggcacaagagaagaaccaccaacagaaccatccccagcgtggacgacttccagaactacctgagagtggccttccaggaggtgaacagcggctgcaccggcaagaccctgctggtgagaccctacatcaccaccgaggacgtgtgccagatctgcgccgagaagttcaaggtgggcgaccccgaggagtacagcctgttcctgttcgtggacgagacctggcagcagctggccgaggacacctacccccagaagatcaaggccgagctgcacagcagaccccagccccacatcttccacttcgtgtacaagagaatcaagaacgacccctacggcatcatcttccagaacggcgaggaggacctgaccaccagctag

SEQ ID NO: 96380 - DNA, 1389 bp, Artificial Sequence
  Description of Artificial Sequence: Synthetic coding sequence
atgaccgcctggaccatgggcgccagaggcctggacaagagaggcagcttcttcaagctgatcgacaccatcgccagcgagatcggcgagctgaagcaggagatggtgagaaccgacgtgaacctggagaacggcctggagcccgccgagacccacagcatggtgagacacaaggacggcggctacagcgaggaggaggacgtgaagacctgcgccagagacagcggctacgacagcctgagcaacagactgagcatcctggacagactgctgcacacccaccccatctggctgcagctgagcctgagcgaggaggaggccgccgaggtgctgcaggcccagccccccggcatcttcctggtgcacaagagcaccaagatgcagaagaaggtgctgagcctgagactgccctgcgagttcggcgcccccctgaaggagttcgccatcaaggagagcacctacaacgtggtgctggagaaggccatgcacaagtgcatcctgaagcccctgaagggccacgtggaggccatgctgaaggacttccacatggccgacggcagctggaagcagctgaaggagaacctgcagctggtgagacagagaaacccccaggagctgggcgtgttcgcccccacccccgacttcgtggacgtggagaagatcaaggtgaagttcatgaccatgcagaagatgtacagccccgagaagaaggtgatgctgctgctgagagtgtgcaagctgatctacaccgtgatggagaacaacagcggcagaatgtacggcgccgacgacttcctgcccgtgctgacctacgtgatcgcccagtgcgacatgctggagctggacaccgagatcgagtacatgatggagctgctggaccccagcctgctgcacggcgagggcggctactacctgaccagcgcctacggcgccctgagcctgatcaagaacttccaggaggagcaggccgccagactgctgagcagcgagaccagagacaccctgagacagtggcacaagagaagaaccaccaacagaaccatccccagcgtggacgacttccagaactacctgagagtggccttccaggaggtgaacagcggctgcaccggcaagaccctgctggtgagaccctacatcaccaccgaggacgtgtgccagatctgcgccgagaagttcaaggtgggcgaccccgaggagtacagcctgttcctgttcgtggacgagacctggcagcagctggccgaggacacctacccccagaagatcaaggccgagctgcacagcagaccccagccccacatcttccacttcgtgtacaagagaatcaagaacgacccctacggcatcatcttccagaacggcgaggaggacctgaccaccagctag

SEQ ID NO: 96381 - DNA, 717 bp, Artificial Sequence
  Description of Artificial Sequence: Synthetic coding sequence
atgagcagcggctacagcagcctggaggaggacgccgaggacttcttcttcaccgccagaaccagcttcttcagaagagccccccagggcaagcccagaagcggccagcaggacgtggagaaggagaaggagacccacagctacctgagcaaggaggagatcaaggagaaggtgcacaagtacaacctggccgtgaccgacaagctgaagatgaccctgaacagcaacggcatctacaccggcttcatcaaggtgcagatggagctgtgcaagcccccccagaccagccccaacagcggcaagctgagccccagcagcaacggctgcatgaacaccctgcacatcagcagcaccaacaccgtgggcgaggtgatcgaggccctgctgaagaagttcctggtgaccgagagccccgccaagttcgccctgtacaagagatgccacagagaggaccaggtgtacgcctgcaagctgagcgacagagagcaccccctgtacctgagactggtggccggccccagaaccgacaccctgagcttcgtgctgagagagcacgagatcggcgagtgggaggccttcagcctgcccgagctgcagaacttcctgagaatcctggacaaggaggaggacgagcagctgcagaacctgaagagaagatacaccgcctacagacagaagctggaggaggccctgagagaggtgtggaagcccgactag

SEQ ID NO: 96382 - DNA, 507 bp, Artificial Sequence
  Description of Artificial Sequence: Synthetic coding sequence
atgaccctgaacagcaacggcatctacaccggcttcatcaaggtgcagatggagctgtgcaagcccccccagaccagccccaacagcggcaagctgagccccagcagcaacggctgcatgaacaccctgcacatcagcagcaccaacaccgtgggcgaggtgatcgaggccctgctgaagaagttcctggtgaccgagagccccgccaagttcgccctgtacaagagatgccacagagaggaccaggtgtacgcctgcaagctgagcgacagagagcaccccctgtacctgagactggtggccggccccagaaccgacaccctgagcttcgtgctgagagagcacgagatcggcgagtgggaggccttcagcctgcccgagctgcagaacttcctgagaatcctggacaaggaggaggacgagcagctgcagaacctgaagagaagatacaccgcctacagacagaagctggaggaggccctgagagaggtgtggaagcccgactag

SEQ ID NO: 96383 - DNA, 717 bp, Artificial Sequence; identical to SEQ ID NO: 96381
  Description of Artificial Sequence: Synthetic coding sequence

SEQ ID NO: 96384 - DNA, 1014 bp, Artificial Sequence
  Description of Artificial Sequence: Synthetic coding sequence
atgaccatgatggcccaccagtaccccagctggatcttcatcaacgagaagaccttcatcaccagagagcagctgaacagcctgctgaagacctacaacatcttctacgagaaccagaagaacctgcacatcctgtacggcgagaccgaggacggcaagctgatcgtggagggcatgctggacatcttctggggcgtgaagagacccatccagctgaagatccaggacgagaagcccttcagcagcttcaccagcatgaagagcagcgacgtgttcagcagcaagggcatgaccagatggggcgagttcgacgacctgtacagaatcagcgagctggacagaacccagatccccatgagcgagaagagaaacagccaggaggactacctgagctaccacagcaacaccctgaagccccacgccaaggacgagcccgacagccccgtgctgtacagaaccatgagcgaggccgccctggtgagaaagagaatgaagcccctgatgatggacagaaaggagagacagaagaacagagccagcatcaacggccacttctacaaccacgagaccagcatcttcatccccgccttcgagagcgagaccaaggtgagagtgaacagcaacatgagaaccgaggaggtgatcaagcagctgctgcagaagttcaagatcgagaacagcccccaggacttcgccctgcacatcatcttcgccaccggcgagcagagaagactgaagaagaccgacatccccctgctgcagagactgctgcagggccccagcgagaagaacgccagaatcttcctgatggacaaggacgccgaggagatcagcagcgacgtggcccagtacatcaacttccacttcagcctgctggagagcatcctgcagagactgaacgaggaggagaagagagagatccagagaatcgtgaccaagttcaacaaggagaaggccatcatcctgaagtgcctgcagaacaagctggtgatcaagaccgagaccaccgtgtag

SEQ ID NO: 96385 - DNA, 978 bp, Artificial Sequence
  Description of Artificial Sequence: Synthetic coding sequence
atgctgtgggaggagaccggcgccgcccccgcccccgccagagccagcgacctgccctacagaatccacttcctgagcagcggcctgatcctggtgaccagacagctgaccgaggacggcaagctgatcgtggagggcatgctggacatcttctggggcgtgaagagacccatccagctgaagatccaggacgagaagcccttcagcagcttcaccagcatgaagagcagcgacgtgttcagcagcaagggcatgaccagatggggcgagttcgacgacctgtacagaatcagcgagctggacagaacccagatccccatgagcgagaagagaaacagccaggaggactacctgagctaccacagcaacaccctgaagccccacgccaaggacgagcccgacagccccgtgctgtacagaaccatgagcgaggccgccctggtgagaaagagaatgaagcccctgatgatggacagaaaggagagacagaagaacagagccagcatcaacggccacttctacaaccacgagaccagcatcttcatccccgccttcgagagcgagaccaaggtgagagtgaacagcaacatgagaaccgaggaggtgatcaagcagctgctgcagaagttcaagatcgagaacagcccccaggacttcgccctgcacatcatcttcgccaccggcgagcagagaagactgaagaagaccgacatccccctgctgcagagactgctgcagggccccagcgagaagaacgccagaatcttcctgatggacaaggacgccgaggagatcagcagcgacgtggcccagtacatcaacttccacttcagcctgctggagagcatcctgcagagactgaacgaggaggagaagagagagatccagagaatcgtgaccaagttcaacaaggagaaggccatcatcctgaagtgcctgcagaacaagctggtgatcaagaccgagaccaccgtgtag

SEQ ID NO: 96386 - DNA, 1110 bp, Artificial Sequence
  Description of Artificial Sequence: Synthetic coding sequence
atgctgtgggaggagaccggcgccgcccccgcccccgccagagccagcgacctgccctacagaatcagcagcgaccacctgaagaaggaggagaagatgaccatgatggcccaccagtaccccagctggatcttcatcaacgagaagaccttcatcaccagagagcagctgaacagcctgctgaagacctacaacatcttctacgagaaccagaagaacctgcacatcctgtacggcgagaccgaggacggcaagctgatcgtggagggcatgctggacatcttctggggcgtgaagagacccatccagctgaagatccaggacgagaagcccttcagcagcttcaccagcatgaagagcagcgacgtgttcagcagcaagggcatgaccagatggggcgagttcgacgacctgtacagaatcagcgagctggacagaacccagatccccatgagcgagaagagaaacagccaggaggactacctgagctaccacagcaacaccctgaagccccacgccaaggacgagcccgacagccccgtgctgtacagaaccatgagcgaggccgccctggtgagaaagagaatgaagcccctgatgatggacagaaaggagagacagaagaacagagccagcatcaacggccacttctacaaccacgagaccagcatcttcatccccgccttcgagagcgagaccaaggtgagagtgaacagcaacatgagaaccgaggaggtgatcaagcagctgctgcagaagttcaagatcgagaacagcccccaggacttcgccctgcacatcatcttcgccaccggcgagcagagaagactgaagaagaccgacatccccctgctgcagagactgctgcagggccccagcgagaagaacgccagaatcttcctgatggacaaggacgccgaggagatcagcagcgacgtggcccagtacatcaacttccacttcagcctgctggagagcatcctgcagagactgaacgaggaggagaagagagagatccagagaatcgtgaccaagttcaacaaggagaaggccatcatcctgaagtgcctgcagaacaagctggtgatcaagaccgagaccaccgtgtag

SEQ ID NO: 96387 - DNA, 912 bp, Artificial Sequence
  Description of Artificial Sequence: Synthetic coding sequence
atgaccatgatggcccaccagtaccccagctggatcttcatcaacgagaagaccttcatcaccagagagcagctgaacagcctgctgaagacctacaacatcttctacgagaaccagaagaacctgcacatcctgtacggcgagaccgaggacggcaagctgatcgtggagggcatgctggacatcttctggggcgtgaagagacccatccagctgaagatccaggacgagaagcccttcagcagcttcaccagcatgaagagcagcgacgtgttcagcagcaagggcatgaccagatggggcgagttcgacgacctgtacagaatcagcgagctggacagaacccagatccccatgagcgagaagagaaacagccaggaggactacctgagctaccacagcaacaccctgaagccccacgccaaggacgagcccgacagccccgtgctgtacagaaccatgagcgaggccgccctggtgagaaagagaatgaagcccctgatgatggacagaaaggagagacagaagaacagagccagcatcaacggccacttctacaaccacgagatcgagaacagcccccaggacttcgccctgcacatcatcttcgccaccggcgagcagagaagactgaagaagaccgacatccccctgctgcagagactgctgcagggccccagcgagaagaacgccagaatcttcctgatggacaaggacgccgaggagatcagcagcgacgtggcccagtacatcaacttccacttcagcctgctggagagcatcctgcagagactgaacgaggaggagaagagagagatccagagaatcgtgaccaagttcaacaaggagaaggccatcatcctgaagtgcctgcagaacaagctggtgatcaagaccgagaccaccgtgtag

SEQ ID NO: 96388 - DNA, 3141 bp, Artificial Sequence
  Description of Artificial Sequence: Synthetic coding sequence
atgctgagcagaaccctgagctacaagtacagagacctggacagcaccttcagcagcctgggcgccagcgacgaccccgccgagctgagcacccagctgagcgcccccggcgtgctgaaggtgttcggcgacagcgtgtgcaccggcacccactacaagagcgtgctggccaccggcaccagcagcgccagagagctggtgaaggaggccctggagagatacgccctggaccccagacaggccggccagtacgtgctgtgcgacgtggtgggccaggccggcgacgccggccagagatggcaggccagatgcttcagagtgttcggcgacagcgagaagcccctgctgatccaggagctgtggaagcccagagagggcctgagcagaagattcgagctgagaaagagaagcgacgtggaggagctggccgccaaggaggtggacaccatcaccgccggcatcaacgcccaggccagaagactgcagagaagcagagccaagggcacccccacccccgccctgggcgacgccagaagcagccccccccccagactgagaagaaccgtgagcgagaccagcctgagccccgtgaacgccctgcccgccgccgcccagggccccgaggagcccggccccgacgccatgagatacagcctgtaccagagcccccacctgctgctgctgcagggctacagccagcagcaccccggcgtgtgcgcccagcccggccccgcccacggcggccccgccgaccccagcaagcccagcatcagcctgagcgcccccgacatcctgcccctgcactgcaccatcagaagacagcccctgcccgacagcggccaggccgccggcagactggtgctggagcccatccccggcgcccacatcagcgtgaacttcagcgaggtgggccacagaaccgtggtgctgcaccacggcgacctgctgagcctgggcctgtactacctgctgctgttcaaggaccccgcccaggcccagcccctgcccgccagagccctggccagactgagagccgtgccccagagctgcagactgtgcggcgccgccctgggcgccagaggcgccgccagccccacccaggccgccctgcccagaagacagcagctgctgctggagttcgagccccacctggaggacaccctgctgcagagaatcatgaccctgatcgagcccggcggcgacgaccacaagctgacccccgccttcctgctgtgcctgtgcatccagcacagcgccacccacttccagcccggcaccttcggccagctgctgctgaagatcgccagactgatcagagagaccgtgtgggagaagaccaaggagctggccgagaagcaggcccagctgcaggagcccatcagcctggccagctgcgccatggccgacctggtgcccgacctgcagcccatcctgttctggatgagcaacagcatcgagctgctgtacttcatccagcagaagtgccccctgtacatgcagagcatggaggagcagctggacatcaccggcagcaaggagagcctgttcagctgcaccctgaccgccagcgaggaggccatggccgtgctggaggaggtggtgctgtacgccttccagcagtgcgtgtactacgtgagcaagagcctgtacatctgcctgcccgccctgctggagtgcccccccttccagaccgagagaagagagagctggagcagcgcccccgagctgcccgaggagctgagaagagtggtgagcgtgtaccaggccgccctggacctgctgagacagctgcaggtgcaccccgaggtggccagccagatgctggcctacctgttcttcttcagcggcaccctgctgctgaaccagctgctggacagaggccccagcctgagctgcttccactggcccagaggcgtgcaggcctgcgccagactgcagcagctgctggagtggatgagaagcgccggcttcggcgccgccggcgagcacttcttccagaagctgagctgcaccctgaacctgctggccacccccagagcccagctgatccagatgagctggaccgccctgagagccgccttccccgccctgagccccgcccagctgcacagactgctgacccactaccagctggccagcgccatgggccccatgagcacctgggagcccggcgcccaggacagccccgaggccttcagaagcgaggacgtgctggagagctacgagaaccccccccccatcgtgctgcccagcgacggcttccaggtggacctggaggccaactgcctggacgacagcatctaccagcacctgctgtacgtgagacacttcctgtggggcctgagaagcagagccagccccggcagccccggcagacccggcagcggcgccagccagcccgtgtgccccgagggcatgcaccacgtggtgctggacggccacctggaggcccccagctgccccctggcccccagagaccccggccccgccgccagagaggtggcccccgagagaaccctgcccctgagaggcgccccctgggcccaggccccccccggcagacagcccagcagaggcggcagccaggccggccccccccacaccgacagcagctgcctgctgaccccccccagcacccccctgggccccgagcccggcgaccccgactggcccgagagcggcggcccctgcggcaaggccctgcccgagagacagagaaacggcctgagcggcctgagaggcgccgcccccgagggcgacagcgccgccctggccgaggagagcccccccgcccccagcagcagaagcagcagcaccgaggacttctgctacgtgttcaccgtggagctggagagaggccccagcggcctgggcatgggcctgatcgacggcatgcacacccacctgggcgcccccggcctgtacatccagaccctgctgcccggcagccccgccgccgccgacggcagactgagcctgggcgacagaatcctggaggtgaacggcagcagcctgctgggcctgggctacctgagagccgtggacctgatcagacacggcggcaagaagatgagattcctggtggccaagagcgacgtggagaccgccaagaagatccacttcagaaccccccccctgtag

SEQ ID NO: 96389 - DNA, 3228 bp, Artificial Sequence
  Description of Artificial Sequence: Synthetic coding sequence
atgttctacggcacccacttcatcatgagcccccccaccaagagcaagctgaagagacagagccagctgctgagcagcatgctgagcagaaccctgagctacaagtacagagacctggacagcaccttcagcagcctgggcgccagcgacgaccccgccgagctgagcacccagctgagcgcccccggcgtgctgaaggtgttcggcgacagcgtgtgcaccggcacccactacaagagcgtgctggccaccggcaccagcagcgccagagagctggtgaaggaggccctggagagatacgccctggaccccagacaggccggccagtacgtgctgtgcgacgtggtgggccaggccggcgacgccggccagagatggcaggccagatgcttcagagtgttcggcgacagcgagaagcccctgctgatccaggagctgtggaagcccagagagggcctgagcagaagattcgagctgagaaagagaagcgacgtggaggagctggccgccaaggaggtggacaccatcaccgccggcatcaacgcccaggccagaagactgcagagaagcagagccaagggcacccccacccccgccctgggcgacgccagaagcagccccccccccagactgagaagaaccgtgagcgagaccagcctgagccccgtgaacgccctgcccgccgccgcccagggccccgaggagcccggccccgacgccatgagatacagcctgtaccagagcccccacctgctgctgctgcagggctacagccagcagcacgacagcctggtgtacgtgctgaacagagacagacacaccgtgggccagagaacccccagcagcaagcccagcatcagcctgagcgcccccgacatcctgcccctgcactgcaccatcagaagacagcccctgcccgacagcggccaggccgccggcagactggtgctggagcccatccccggcgcccacatcagcgtgaacttcagcgaggtgggccacagaaccgtggtgctgcaccacggcgacctgctgagcctgggcctgtactacctgctgctgttcaaggaccccgcccaggcccagcccctgcccgccagagccctggccagactgagagccgtgccccagagctgcagactgtgcggcgccgccctgggcgccagaggcgccgccagccccacccaggccgccctgcccagaagacagcagctgctgctggagttcgagccccacctggaggacaccctgctgcagagaatcatgaccctgatcgagcccggcggcgacgaccacaagctgacccccgccttcctgctgtgcctgtgcatccagcacagcgccacccacttccagcccggcaccttcggccagctgctgctgaagatcgccagactgatcagagagaccgtgtgggagaagaccaaggagctggccgagaagcaggcccagctgcaggagcccatcagcctggccagctgcgccatggccgacctggtgcccgacctgcagcccatcctgttctggatgagcaacagcatcgagctgctgtacttcatccagcagaagtgccccctgtacatgcagagcatggaggagcagctggacatcaccggcagcaaggagagcctgttcagctgcaccctgaccgccagcgaggaggccatggccgtgctggaggaggtggtgctgtacgccttccagcagtgcgtgtactacgtgagcaagagcctgtacatctgcctgcccgccctgctggagtgcccccccttccagaccgagagaagagagagctggagcagcgcccccgagctgcccgaggagctgagaagagtggtgagcgtgtaccaggccgccctggacctgctgagacagctgcaggtgcaccccgaggtggccagccagatgctggcctacctgttcttcttcagcggcaccctgctgctgaaccagctgctggacagaggccccagcctgagctgcttccactggcccagaggcgtgcaggcctgcgccagactgcagcagctgctggagtggatgagaagcgccggcttcggcgccgccggcgagcacttcttccagaagctgagctgcaccctgaacctgctggccacccccagagcccagctgatccagatgagctggaccgccctgagagccgccttccccgccctgagccccgcccagctgcacagactgctgacccactaccagctggccagcgccatgggccccatgagcacctgggagcccggcgcccaggacagccccgaggccttcagaagcgaggacgtgctggagagctacgagaaccccccccccatcgtgctgcccagcgacggcttccaggtggacctggaggccaactgcctggacgacagcatctaccagcacctgctgtacgtgagacacttcctgtggggcctgagaagcagagccagccccggcagccccggcagacccggcagcggcgccagccagcccgtgtgccccgagggcatgcaccacgtggtgctggacggccacctggaggcccccagctgccccctggcccccagagaccccggccccgccgccagagaggtggcccccgagagaaccctgcccctgagaggcgccccctgggcccaggccccccccggcagacagcccagcagaggcggcagccaggccggccccccccacaccgacagcagctgcctgctgaccccccccagcacccccctgggccccgagcccggcgaccccgactggcccgagagcggcggcccctgcggcaaggccctgcccgagagacagagaaacggcctgagcggcctgagaggcgccgcccccgagggcgacagcgccgccctggccgaggagagcccccccgcccccagcagcagaagcagcagcaccgaggacttctgctacgtgttcaccgtggagctggagagaggccccagcggcctgggcatgggcctgatcgacggcatgcacacccacctgggcgcccccggcctgtacatccagaccctgctgcccggcagccccgccgccgccgacggcagactgagcctgggcgacagaatcctggaggtgaacggcagcagcctgctgggcctgggctacctgagagccgtggacctgatcagacacggcggcaagaagatgagattcctggtggccaagagcgacgtggagaccgccaagaagatccacttcagaaccccccccctgtag

SEQ ID NO: 96390 - DNA, 405 bp, Artificial Sequence
  Description of Artificial Sequence: Synthetic coding sequence
atgttctacggcacccacttcatcatgagcccccccaccaagagcaagctgaagagacagagccagctgctgagcagcatgctgagcagaaccctgagctacaagtacagagacctggacagcaccttcagcagcctgggcgccagcgacgaccccgccgagctgagcacccagctgagcgcccccggcgtgctgaaggtgttcggcgacagcgtgtgcaccggcacccactacaagagcgtgctggccaccggcaccagcagcgccagagagctggtgaaggaggccctggagagatacgccctggaccccagacaggccggccagtacgtgctgtgcgacgtggtgggccaggccggcgacgccggccagagatggcaggccagatgcttcagagtgttctag

SEQ ID NO: 96391 - DNA, 1629 bp, Artificial Sequence
  Description of Artificial Sequence: Synthetic coding sequence
atgttctacggcacccacttcatcatgagcccccccaccaagagcaagctgaagagacagagccagctgctgagcagcatgctgagcagaaccctgagctacaagtacagagacctggacagcaccttcagcagcctgggcgccagcgacgaccccgccgagctgagcacccagctgagcgcccccggcgtgctgaaggtgttcggcgacagcgtgtgcaccggcacccactacaagagcgtgctggccaccggcaccagcagcgccagagagctggtgaaggaggccctggagagatacgccctggaccccagacaggccggccagtacgtgctgtgcgacgtggtgggccaggccggcgacgccggccagagatggcaggccagatgcttcagagtgttcggcgacagcgagaagcccctgctgatccaggagctgtggaagcccagagagggcctgagcagaagattcgagctgagaaagagaagcgacgtggaggagctggccgccaaggaggtggacaccatcaccgccggcatcaacgcccaggccagaagactgcagagaagcagagccaagggcacccccacccccgccctgggcgacgccagaagcagccccccccccagactgagaagaaccgtgagcgagaccagcctgagccccgtgaacgccctgcccgccgccgcccagggccccgaggagcccggccccgacgccatgagatacagcctgtaccagagcccccacctgctgctgctgcagggctacagccagcagcacgacagcctggtgtacgtgctgaacagagacagacacaccgtgggccagagaacccccagcagcaagcccagcatcagcctgagcgcccccgacatcctgcccctgcactgcaccatcagaagacagcccctgcccgacagcggccaggccgccggcagactggtgctggagcccatccccggcgcccacatcagcgtgaacttcagcgaggtgggccacagaaccgtggtgctgcaccacggcgacctgctgagcctgggcctgtactacctgctgctgttcaaggaccccgcccaggcccagcccctgcccgccagagccctggccagactgagagccgtgccccagagctgcagactgtgcggcgccgccctgggcgccagaggcgccgccagccccacccaggccgccctgcccagaagacagcagctgctgctggagttcgagccccacctggaggacaccctgctgcagagaatcatgaccctgatcgagcccggcggcgacgaccacaagctgacccccgccttcctgctgtgcctgtgcatccagcacagcgccacccacttccagcccggcaccttcggccagctgctgctgaagatcgccagactgatcagagagaccgtgtgggagaagaccaaggagctggccgagaagcaggcccagctgctggagggcatcgccgtgctgctgcacgccgacggccagagaggcggccacggcggcgccggcggcggcggcgccgtgagactgcccgccgtgagactgctgtgcctgcaggtgcccgtgcacctgccccccggcacccccggcgtgcccgccatccccgacggcgccccctag

SEQ ID NO: 96392 - DNA, 2508 bp, Artificial Sequence
  Description of Artificial Sequence: Synthetic coding sequence
atgagatacagcctgtaccagagcccccacctgctgctgctgcagggctacagccagcagcacgacagcctggtgtacgtgctgaacagagacagacacaccgtgggccagagaacccccagcagcaagcccagcatcagcctgagcgcccccgacatcctgcccctgcactgcaccatcagaagacagcccctgcccgacagcggccaggccgccggcagactggtgctggagcccatccccggcgcccacatcagcgtgaacttcagcgaggtgggccacagaaccgtggtgctgcaccacggcgacctgctgagcctgggcctgtactacctgctgctgttcaaggaccccgcccaggcccagcccctgcccgccagagccctggccagactgagagccgtgccccagagctgcagactgtgcggcgccgccctgggcgccagaggcgccgccagccccacccaggccgccctgcccagaagacagcagctgctgctggagttcgagccccacctggaggacaccctgctgcagagaatcatgaccctgatcgagcccggcggcgacgaccacaagctgacccccgccttcctgctgtgcctgtgcatccagcacagcgccacccacttccagcccggcaccttcggccagctgctgctgaagatcgccagactgatcagagagaccgtgtgggagaagaccaaggagctggccgagaagcaggcccagctgcaggagcccatcagcctggccagctgcgccatggccgacctggtgcccgacctgcagcccatcctgttctggatgagcaacagcatcgagctgctgtacttcatccagcagaagtgccccctgtacatgcagagcatggaggagcagctggacatcaccggcagcaaggagagcctgttcagctgcaccctgaccgccagcgaggaggccatggccgtgctggaggaggtggtgctgtacgccttccagcagtgcgtgtactacgtgagcaagagcctgtacatctgcctgcccgccctgctggagtgcccccccttccagaccgagagaagagagagctggagcagcgcccccgagctgcccgaggagctgagaagagtggtgagcgtgtaccaggccgccctggacctgctgagacagctgcaggtgcaccccgaggtggccagccagatgctggcctacctgttcttcttcagcggcaccctgctgctgaaccagctgctggacagaggccccagcctgagctgcttccactggcccagaggcgtgcaggcctgcgccagactgcagcagctgctggagtggatgagaagcgccggcttcggcgccgccggcgagcacttcttccagaagctgagctgcaccctgaacctgctggccacccccagagcccagctgatccagatgagctggaccgccctgagagccgccttccccgccctgagccccgcccagctgcacagactgctgacccactaccagctggccagcgccatgggccccatgagcacctgggagcccggcgcccaggacagccccgaggccttcagaagcgaggacgtgctggagagctacgagaaccccccccccatcgtgctgcccagcgacggcttccaggtggacctggaggccaactgcctggacgacagcatctaccagcacctgctgtacgtgagacacttcctgtggggcctgagaagcagagccagccccggcagccccggcagacccggcagcggcgccagccagcccgtgtgccccgagggcatgcaccacgtggtgctggacggccacctggaggcccccagctgccccctggcccccagagaccccggccccgccgccagagaggtggcccccgagagaaccctgcccctgagaggcgccccctgggcccaggccccccccggcagacagcccagcagaggcggcagccaggccggccccccccacaccgacagcagctgcctgctgaccccccccagcacccccctgggccccgagcccggcgaccccgactggcccgagagcggcggcccctgcggcaaggccctgcccgagagacagagaaacggcctgagcggcctgagaggcgccgcccccgagggcgacagcgccgccctggccgaggagagcccccccgcccccagcagcagaagcagcagcaccgaggacttctgctacgtgttcaccgtggagctggagagaggccccagcggcctgggcatgggcctgatcgacggcatgcacacccacctgggcgcccccggcctgtacatccagaccctgctgcccggcagccccgccgccgccgacggcagactgagcctgggcgacagaatcctggaggtgaacggcagcagcctgctgggcctgggctacctgagagccgtggacctgatcagacacggcggcaagaagatgagattcctggtggccaagagcgacgtggagaccgccaagaagatccacttcagaaccccccccctgtag

SEQ ID NO: 96393 - DNA, 2085 bp, Artificial Sequence
  Description of Artificial Sequence: Synthetic coding sequence
atgtgcagcaccggcaccggcaccagatgggccagcggccccccccccgccagccccgccagcgccagccagccccccaccagctgcctgtacaccgcccccagcgccggcaacagaagcagaaccgccgccagacccagaggcggctggctggagcccatccccggcgcccacatcagcgtgaacttcagcgaggtgggccacagaaccgtggtgctgcaccacggcgacctgctgagcctgggcctgtactacctgctgctgttcaaggaccccgcccaggcccagcccctgcccgccagagccctggccagactgagagccgtgccccagagctgcagactgtgcggcgccgccctgggcgccagaggcgccgccagccccacccaggccgccctgcccagaagacagcagctgctgctggagttcgagccccacctggaggacaccctgctgcagagaatcatgaccctgatcgagcccggcggcgacgaccacaagctgacccccgccttcctgctgtgcctgtgcatccagcacagcgccacccacttccagcccggcaccttcggccagctgctgctgaagatcgccagactgatcagagagaccgtgtgggagaagaccaaggagctggccgagaagcaggcccagctgcaggagcccatcagcctggccagctgcgccatggccgacctggtgcccgacctgcagcccatcctgttctggatgagcaacagcatcgagctgctgtacttcatccagcagaagtgccccctgtacatgcagagcatggaggagcagctggacatcaccggcagcaaggagagcctgttcagctgcaccctgaccgccagcgaggaggccatggccgtgctggaggaggtggtgctgtacgccttccagcagtgcgtgtactacgtgagcaagagcctgtacatctgcctgcccgccctgctggagtgcccccccttccagaccgagagaagagagagctggagcagcgcccccgagctgcccgaggagctgagaagagtggtgagcgtgtaccaggccgccctggacctgctgagacagctgcaggtgcaccccgaggtggccagccagatgctggcctacctgttcttcttcagcggcaccctgctgctgaaccagctgctggacagaggccccagcctgagctgcttccactggcccagaggcgtgcaggcctgcgccagactgcagcagctgctggagtggatgagaagcgccggcttcggcgccgccggcgagcacttcttccagaagctgagctgcaccctgaacctgctggccacccccagagcccagctgatccagatgagctggaccgccctgagagccgccttccccgccctgagccccgcccagctgcacagactgctgacccactaccagctggccagcgccatgggccccatgagcacctgggagcccggcgcccaggacagccccgaggccttcagaagcgaggacgtgctggagagctacgagaaccccccccccatcgtgctgcccagcgacggcttccaggtggacctggaggccaactgcctggacgacagcatctaccagcacctgctgtacgtgagacacttcctgtggggcctgagaagcagagccagccccggcagccccggcagacccggcagcggcgccagccagcccgtgtgccccgagggcatgcaccacgtggtgctggacggccacctggaggcccccagctgccccctggcccccagagaccccggccccgccgccagagaggtggcccccgagagaaccctgcccctgagaggcgccccctgggcccaggccccccccggcagacagccccccggcctgtacatccagaccctgctgcccggcagccccgccgccgccgacggcagactgagcctgggcgacagaatcctggaggtgaacggcagcagcctgctgggcctgggctacctgagagccgtggacctgatcagacacggcggcaagaagatgagattcctggtggccaagagcgacgtggagaccgccaagaagatccacttcagaaccccccccctgtag

SEQ ID NO: 96394 - DNA, 369 bp, Artificial Sequence
  Description of Artificial Sequence: Synthetic coding sequence
atgaagctggccgccatgatcaagaagatgtgccccagcgacagcgagctgagcatccccgccaagaactgctacagaatggtgatcctgggcagcagcaaggtgggcaagaccgccatcgtgagcagattcctgaccggcagattcgaggacgcctacacccccaccatcgaggacttccacagaaagttctacagcatcagaggcgaggtgtaccagctggacatcctggacaccagcggcaaccaccccttccccgccatgagaagactgagcatcctgaccgaccccagacaccaggtgctgccccaggagcagaaccagggcgagagaggcagagcccccggccacctgagacagcagggctag

SEQ ID NO: 96395 - DNA, 2394 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtacaaggacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagccccccccctgacccccagcaagccccccgtggtggtggactgggccagcggcgtgagccccaagcccgaccccaagaccatcagcaagcacgtgcagagaatggtggacagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaaggactgcggcatgaactgccacaagcagtgcaaggacctggtggtgttcgagtgcaagaagagagccaagaaccccgtggcccccaccgagaacaacaccagcgtgggccccgtgagcaacctgtgcagcctgggcgccaaggacctgctgcacgcccccgaggagggccccttcaccttccccaacggcgaggccgtggagcacggcgaggagagcaaggacagaaccatcatgctgatgggcgtgagcagccagaagatcagcctgagactgaagagagccgtggcccacaaggccacccagaccgagagccagccctggatcggcagcgagggccccagcggccccttcgtgctgagcagccccagaaagaccgcccaggacaccctgtacgtgctgcccagccccaccagcccctgccccagccccgtgctggtgagaaagagagccttcgtgaagtgggagaacaaggacagcctgatcaagagcaaggaggagctgagacacctgagactgcccacctaccaggagctggagcaggagatcaacaccctgaaggccgacaacgacgccctgaagatccagctgaagtacgcccagaagaagatcgagagcctgcagctggagaagagcaaccacgtgctggcccagatggagcagggcgactgcagctag

SEQ ID NO: 96396 - DNA, 1794 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtaccccgacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaaggactgcggcatgaactgccacaagcagtgcaaggacctggtggtgttcgagtgcaagaagagagccaagaaccccgtggcccccaccgagaacaacaccagcgtgggccccgtgagcaacctgtgcagcctgggcgccaaggacctgctgcacggcaacaagtacagcgagagcagatag

SEQ ID NO: 96397 - DNA, 1641 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtaccccgacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaagggcaacaagtacagcgagagcagatag

SEQ ID NO: 96398 - DNA, 2289 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtacaaggacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaaggactgcggcatgaactgccacaagcagtgcaaggacctggtggtgttcgagtgcaagaagagagccaagaaccccgtggcccccaccgagaacaacaccagcgtgggccccgtgagcaacctgtgcagcctgggcgccaaggacctgctgcacgcccccgaggagggccccttcaccttccccaacggcgaggccgtggagcacggcgaggagagcaaggacagaaccatcatgctgatgggcgtgagcagccagaagatcagcctgagactgaagagagccgtggcccacaaggccacccagaccgagagccagccctggatcggcagcgagggccccagcggccccttcgtgctgagcagccccagaaagaccgcccaggacaccctgtacgtgctgcccagccccaccagcccctgccccagccccgtgctggtgagaaagagagccttcgtgaagtgggagaacaaggacagcctgatcaagagcaaggaggagctgagacacctgagactgcccacctaccaggagctggagcaggagatcaacaccctgaaggccgacaacgacgccctgaagatccagctgaagtacgcccagaagaagatcgagagcctgcagctggagaagagcaaccacgtgctggcccagatggagcagggcgactgcagctag

SEQ ID NO: 96399 - DNA, 2250 bp, Artificial Sequence
  Description of Artificial Sequence: Synthetic coding sequence
atgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtacaaggacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagccccccccctgacccccagcaagccccccgtggtggtggactgggccagcggcgtgagccccaagcccgaccccaagaccatcagcaagcacgtgcagagaatggtggacagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaaggactgcggcatgaactgccacaagcagtgcaaggacctggtggtgttcgagtgcaagaagagagccaagaaccccgtggcccccaccgagaacaacaccagcgtgggccccgtgagcaacctgtgcagcctgggcgccaaggacctgctgcacgcccccgaggagggccccttcaccttccccaacggcgaggccgtggagcacggcgaggagagcaaggacagaaccatcatgctgatgggcgtgagcagccagaagatcagcctgagactgaagagagccgtggcccacaaggccacccagaccgagagccagccctggatcggcagcgagggccccagcggccccttcgtgctgagcagccccagaaagaccgcccaggacaccctgtacgtgctgcccagccccaccagcccctgccccagccccgtgctggtgagaaagagagccttcgtgaagtgggagaacaaggacagcctgatcaagagcaaggaggagctgagacacctgagactgcccacctaccaggagctggagcaggagatcaacaccctgaaggccgacaacgacgccctgaagatccagctgaagtacgcccagaagaagatcgagagcctgcagctggagaagagcaaccacgtgctggcccagatggagcagggcgactgcagctag

SEQ ID NO: 96400 - DNA, 1446 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtaccccgacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagaagcggcgcctag

SEQ ID NO: 96401 - DNA, 1641 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtacaaggacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaagggcaacaagtacagcgagagcagatag

SEQ ID NO: 96402 - DNA, 1794 bp, Artificial Sequence
  Description of Artificial Sequence: Synthetic coding sequence
atgggcaccctgggcaaggccagagaggcccccagaaagcccagccacggctgcagagccgccagcaaggccagactggaggccaagcccgccaacagccccttccccagccaccccagcctggcccacatcacccagttcagaatgatggtgagcctgggccacctggccaagggcgccagcctggacgacctgatcgacagctgcatccagagcttcgacgccgacggcaacctgtgcagaagcaaccagctgctgcaggtgatgctgaccatgcacagaatcgtgatcagcagcgccgagctgctgcagaaggtgatcaccctgtacaaggacgccctggccaagaacagccccggcctgtgcctgaagatctgctacttcgtgagatactggatcaccgagttctgggtgatgttcaagatggacgccagcctgaccgacaccatggaggagttccaggagctggtgaaggccaagggcgaggagctgcactgcagactgatcgacaccacccagatcaacgccagagactggagcagaaagctgacccagagaatcaagagcaacaccagcaagaagagaaaggtgagcctgctgttcgaccacctggagcccgaggagctgagcgagcacctgacctacctggagttcaagagcttcagaagaatcagcttcagcgactaccagaactacctggtgaacagctgcgtgaaggagaaccccaccatggagagaagcatcgccctgtgcaacggcatcagccagtgggtgcagctgatggtgctgagcagacccaccccccagctgagagccgaggtgttcatcaagttcatccaggtggcccagaagctgcaccagctgcagaacttcaacaccctgatggccgtgatcggcggcctgtgccacagcagcatcagcagactgaaggagaccagcagccacgtgccccacgagatcaacaaggtgctgggcgagatgaccgagctgctgagcagcagcagaaactacgacaactacagaagagcctacggcgagtgcaccgacttcaagatccccatcctgggcgtgcacctgaaggacctgatcagcctgtacgaggccatgcccgactacctggaggacggcaaggtgaacgtgcacaagctgctggccctgtacaaccacatcagcgagctggtgcagctgcaggaggtggccccccccctggaggccaacaaggacctggtgcacctgctgaccctgagcctggacctgtactacaccgaggacgagatctacgagctgagctacgccagagagcccagaaaccacagagcccccagcgtgttcaagaactacgaccacgaccaggacggctacatcagccaggaggagttcgagaagatcgccgccagcttccccttcagcttctgcgtgatggacaaggacagagagggcctgatcagcagagacgagatcaccgcctacttcatgagagccagcagcatctacagcaagctgggcctgggcttcccccacaacttccaggagaccacctacctgaagcccaccttctgcgacaactgcgccggcttcctgtggggcgtgatcaagcagggctacagatgcaaggactgcggcatgaactgccacaagcagtgcaaggacctggtggtgttcgagtgcaagaagagagccaagaaccccgtggcccccaccgagaacaacaccagcgtgggccccgtgagcaacctgtgcagcctgggcgccaaggacctgctgcacggcaacaagtacagcgagagcagatag

SEQ ID NO: 96403 - DNA, 1830 bp, Artificial Sequence
  Description of Artificial Sequence: Synthetic coding sequence
atggccggcaccctggacctggacaagggctgcaccgtggaggagctgctgagaggctgcatcgaggccttcgacgacagcggcaaggtgagagacccccagctggtgagaatgttcctgatgatgcacccctggtacatccccagcagccagctggccgccaagctgctgcacatctaccagcagagcagaaaggacaacagcaacagcctgcaggtgaagacctgccacctggtgagatactggatcagcgccttccccgccgagttcgacctgaaccccgagctggccgagcagatcaaggagctgaaggccctgctggaccaggagggcaacagaagacacagcagcctgatcgacatcgacagcgtgcccacctacaagtggaagagacaggtgacccagagaaaccccgtgggccagaagaagagaaagatgagcctgctgttcgaccacctggagcccatggagctggccgagcacctgacctacctggagtacagaagcttctgcaagatcctgttccaggactaccacagcttcgtgacccacggctgcaccgtggacaaccccgtgctggagagattcatcagcctgttcaacagcgtgagccagtgggtgcagctgatgatcctgagcaagcccaccgccccccagagagccctggtgatcacccacttcgtgcacgtggccgagaagctgctgcagctgcagaacttcaacaccctgatggccgtggtgggcggcctgagccacagcagcatcagcagactgaaggagacccacagccacgtgagccccgagaccatcaagctgtgggagggcctgaccgagctggtgaccgccaccggcaactacggcaactacagaagaagactggccgcctgcgtgggcttcagattccccatcctgggcgtgcacctgaaggacctggtggccctgcagctggccctgcccgactggctggaccccgccagaaccagactgaacggcgccaagatgaagcagctgttcagcatcctggaggagctggccatggtgaccagcctgagaccccccgtgcaggccaaccccgacctgctgagcctgctgaccgtgagcctggaccagtaccagaccgaggacgagctgtaccagctgagcctgcagagagagcccagaagcaagagcagccccaccagccccaccagctgcacccccccccccagaccccccgtgctggaggagtggaccagcgccgccaagcccaagctggaccaggccctggtggtggagcacatcgagaagatggtggagagcgtgttcagaaacttcgacgtggacggcgacggccacatcagccaggaggagttccagatcatcagaggcaacttcccctacctgagcgccttcggcgacctggaccagaaccaggacggctgcatcagcagagaggagatggtgagctacttcctgagaagcagcagcgtgctgggcggcagaatgggcttcgtgcacaacttccaggagagcaacagcctgagacccgtggcctgcagacactgcaaggccctgatcctgggcatctacaagcagggcctgaagtgcagagcctgcggcgtgaactgccacaagcagtgcaaggacagactgagcgtggagtgcagaagaagagcccagagcgtgagcctggagggcagcgcccccagccccagccccatgcacagccaccaccacagagccttcagcttcagcctgcccagacccggcagaagaggcagcagaccccccgagatcagagaggaggaggtgcagaccgtggaggacggcgtgttcgacatccacctgtag

SEQ ID NO: 96404 - DNA, 1833 bp, Artificial Sequence
  Description of Artificial Sequence: Synthetic coding sequence
atggccggcaccctggacctggacaagggctgcaccgtggaggagctgctgagaggctgcatcgaggccttcgacgacagcggcaaggtgagagacccccagctggtgagaatgttcctgatgatgcacccctggtacatccccagcagccagctggccgccaagctgctgcacatctaccagcagagcagaaaggacaacagcaacagcctgcaggtgaagacctgccacctggtgagatactggatcagcgccttccccgccgagttcgacctgaaccccgagctggccgagcagatcaaggagctgaaggccctgctggaccaggagggcaacagaagacacagcagcctgatcgacatcgacagcgtgcccacctacaagtggaagagacaggtgacccagagaaaccccgtgggccagaagaagagaaagatgagcctgctgttcgaccacctggagcccatggagctggccgagcacctgacctacctggagtacagaagcttctgcaagatcctgttccaggactaccacagcttcgtgacccacggctgcaccgtggacaaccccgtgctggagagattcatcagcctgttcaacagcgtgagccagtgggtgcagctgatgatcctgagcaagcccaccgccccccagagagccctggtgatcacccacttcgtgcacgtggccgagaagctgctgcagctgcagaacttcaacaccctgatggccgtggtgggcggcctgagccacagcagcatcagcagactgaaggagacccacagccacgtgagccccgagaccatcaagctgtgggagggcctgaccgagctggtgaccgccaccggcaactacggcaactacagaagaagactggccgcctgcgtgggcttcagattccccatcctgggcgtgcacctgaaggacctggtggccctgcagctggccctgcccgactggctggaccccgccagaaccagactgaacggcgccaagatgaagcagctgttcagcatcctggaggagctggccatggtgaccagcctgagaccccccgtgcaggccaaccccgacctgctgagcctgctgaccgtgagcctggaccagtaccagaccgaggacgagctgtaccagctgagcctgcagagagagcccagaagcaagagcagccccaccagccccaccagctgcacccccccccccagaccccccgtgctggaggagtggaccagcgccgccaagcccaagctggaccaggccctggtggtggagcacatcgagaagatggtggagagcgtgttcagaaacttcgacgtggacggcgacggccacatcagccaggaggagttccagatcatcagaggcaacttcccctacctgagcgccttcggcgacctggaccagaaccaggacggctgcatcagcagagaggagatggtgagctacttcctgagaagcagcagcgtgctgggcggcagaatgggcttcgtgcacaacttccaggagagcaacagcctgagacccgtggcctgcagacactgcaaggccctgatcctgggcatctacaagcagggcctgaagtgcagagcctgcggcgtgaactgccacaagcagtgcaaggacagactgagcgtggagtgcagaagaagagcccagagcgtgagcctggagggcagcgcccccagccccagccccatgcacagccaccaccacagagccttcagcttcagcctgcccagacccggcagaagaggcagcagaccccccgccgagatcagagaggaggaggtgcagaccgtggaggacggcgtgttcgacatccacctgtag

SEQ ID NO: 96405 - DNA, 1830 bp, Artificial Sequence; identical to SEQ ID NO: 96403
  Description of Artificial Sequence: Synthetic coding sequence

SEQ ID NO: 96406 - DNA, 1830 bp, Artificial Sequence; identical to SEQ ID NO: 96403
  Description of Artificial Sequence: Synthetic coding sequence

SEQ ID NO: 96407 - DNA, 432 bp, Artificial Sequence
  Description of Artificial Sequence: Synthetic coding sequence
atggccggcaccctggacctggacaagggctgcaccgtggaggagctgctgagaggctgcatcgaggccttcgacgacagcggcaaggtgagagacccccagctggtgagaatgttcctgatgatgcacccctggtacatccccagcagccagctggccgccaagctgctgcacatctaccagcagagcagaaaggacaacagcaacagcctgcaggtgaagacctgccacctggtgagatactggatcagcgccttccccgccgagttcgacctgaaccccgagctggccgagcagatcaaggagctgaaggccctgctggaccaggagggcaacagaagacacagcagcctgatcgacatcgacagcgtgtgcgtgggcgagcacagaggcctgggcggccacagcgtgagctacaccatctgcgcctag

SEQ ID NO: 96408 - DNA, 1731 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccgccctgctggagctgaccgagctgctggccagccacaacaactacgccagatacagaagaacctgggccggctgcgccggcttcagactgcccgtgctgggcgtgcacctgaaggacctggtgagcctgcacgaggcccagcccgacagactgcccgacggcagactgcacctgcccaagctgaacaacctgtacctgagactgcaggagctggtggccctgcagggccagcaccccccctgcagcgccaacgaggacctgctgcacctgctgaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96409 - DNA, 1854 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccccccaggacctgagaagctacgtgctgcagggcagcgtgagaggctgccccgccctggagggcagcgtgggcctgagcaacagcgtgagcagatgggtgcaggtgatggtgctgagcagacccggccccctgcagagagcccaggtgctggacaagttcatccacgtggcccagagactgcaccagctgcagaacttcaacaccctgatggccgtgaccggcggcctgtgccacagcgccatcagcagactgaaggacagccacgcccacctgagccccgacagcaccaaggccctgctggagctgaccgagctgctggccagccacaacaactacgccagatacagaagaacctgggccggctgcgccggcttcagactgcccgtgctgggcgtgcacctgaaggacctggtgagcctgcacgaggcccagcccgacagactgcccgacggcagactgcacctgcccaagctgaacaacctgtacctgagactgcaggagctggtggccctgcagggccagcaccccccctgcagcgccaacgaggacctgctgcacctgctgaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagaggcgagtggggcgtgagcgagtgggagggcagcctgggcccccaggccggcagaatggacgacaccgacagaacccccgccgccgccttcccccagagcgccggctgcgtggccaccaacaccgccgagaccagatag

SEQ ID NO: 96410 - DNA, 1455 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96411 - DNA, 1746 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccccccaggacctgagaagctacgtgctgcagggcagcgtgagaggctgccccgccctggagggcagcgtgggcctgagcaacagcgtgagcagatgggtgcaggtgatggtgctgagcagacccggccccctgcagagagcccaggtgctggacaagttcatccacgtggcccagagactgcaccagctgcagaacttcaacaccctgatggccgtgaccggcggcctgtgccacagcgccatcagcagactgaaggacagccacgcccacctgagccccgacagcaccaagctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96412 - DNA, 2022 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccccccaggacctgagaagctacgtgctgcagggcagcgtgagaggctgccccgccctggagggcagcgtgggcctgagcaacagcgtgagcagatgggtgcaggtgatggtgctgagcagacccggccccctgcagagagcccaggtgctggacaagttcatccacgtggcccagagactgcaccagctgcagaacttcaacaccctgatggccgtgaccggcggcctgtgccacagcgccatcagcagactgaaggacagccacgcccacctgagccccgacagcaccaaggccctgctggagctgaccgagctgctggccagccacaacaactacgccagatacagaagaacctgggccggctgcgccggcttcagactgcccgtgctgggcgtgcacctgaaggacctggtgagcctgcacgaggcccagcccgacagactgcccgacggcagactgcacctgcccaagctgaacaacctgtacctgagactgcaggagctggtggccctgcagggccagcaccccccctgcagcgccaacgaggacctgctgcacctgctgaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96413 - DNA, 1980 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgcccggcctgggcaagaagagaaaggtgagcctgctgttcgaccacctggagaccggcgagctggcccagcacctgacctacctggagttcagaagcttccaggccatcaccccccaggacctgagaagctacgtgctgcagggcagcgtgagaggctgccccgccctggagggcagcgtgggcctgagcaacagcgtgagcagatgggtgcaggtgatggtgctgagcagacccggccccctgcagagagcccaggtgctggacaagttcatccacgtggcccagagactgcaccagctgcagaacttcaacaccctgatggccgtgaccggcggcctgtgccacagcgccatcagcagactgaaggacagccacgcccacctgagccccgacagcaccaaggccctgctggagctgaccgagctgctggccagccacaacaactacgccagatacagaagaacctgggccggctgcgccggcttcagactgcccgtgctgggcgtgcacctgaaggacctggtgagcctgcacgaggcccagcccgacagactgcccgacggcagactgcacctgcccaagctgaacaacctgtacctgagactgcaggagctggtggccctgcagggccagcaccccccctgcagcgccaacgaggacctgctgcacctgctgaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96414 - DNA, 1815 bp, Artificial Sequence
  Description of Artificial Sequence: Synthetic coding sequence
atgaacagaaaggacagcaagagaaagagccaccaggagtgcaccggcaagatcggcggcagaggcagacccagacaggtgagaagacacaagacctgccccagccccagagagatcagcaaggtgatggccagcatgaacctgggcctgctgagcgagggcggctgcagcgaggacgagctgctggagaagtgcatccagagcttcgacagcgccggcagcctgtgccacgaggaccacatgctgaacatggtgctggccatgcacagctgggtgctgcccagcgccgacctggccgccagactgctgaccagctaccagaaggccaccggcgacacccaggagctgagaagactgcagatctgccacctggtgagatactggctgatgagacaccccgaggtgatgcaccaggacccccagctggaggaggtgatcggcagattctgggccaccgtggccagagagggcaacagcgcccagagaagactgggcgacagcagcgacctgctgagccccggcggccccggcccccccctgcccatgagcagccccggcctgggcaagaagagaaaggtgagcctgctgttcgaccacctggagaccggcgagctggcccagcacctgacctacctggagttcagaagcttccaggccatcaccccccaggacctgagaagctacgtgctgcagggcagcgtgagaggctgccccgccctggagggcagcgtgggcctgagcaacagcgtgagcagatgggtgcaggtgatggtgctgagcagacccggccccctgcagagagcccaggtgctggacaagttcatccacgtggcccagagactgcaccagctgcagaacttcaacaccctgatggccgtgaccggcggcctgtgccacagcgccatcagcagactgaaggacagccacgcccacctgagccccgacagcaccaaggagctggtggccctgcagggccagcaccccccctgcagcgccaacgaggacctgctgcacctgctgaccctgagcctggacctgttctacaccgaggacgagatctacgagctgagctacgccagagagcccagatgccccaagagcctgccccccagccccttcaacgcccccctggtggtggagtgggcccccggcgtgacccccaagcccgacagagtgaccctgggcagacacgtggagcagctggtggagagcgtgttcaagaactacgaccccgagggcagaggcaccatcagccaggaggacttcgagagactgagcggcaacttccccttcgcctgccacggcctgcaccccccccccagacagggcagaggcagcttcagcagagaggagctgaccggctacctgctgagagccagcgccatctgcagcaagctgggcctggccttcctgcacaccttccacgaggtgaccttcagaaagcccaccttctgcgacagctgcagcggcttcctgtggggcgtgaccaagcagggctacagatgcagagagtgcggcctgtgctgccacaagcactgcagagaccaggtgaaggtggagtgcaagaagagacccggcgccaagggcgacgccggcccccccggcgcccccgtgcccagcacccccgccccccacgccagctgcggcagcgaggagaaccacagctacaccctgagcctggagcccgagaccggctgccagctgagacacgcctggacccagaccgagagcccccaccccagctgggagaccgacaccgtgccctgccccgtgatggacccccccagcaccgccagcagcaagctggacagctag

SEQ ID NO: 96415 - DNA, 1857 bp, Artificial Sequence
  Description of Artificial Sequence: Synthetic coding sequence
atgaagaaggacgtgagaatcctgctggtgggcgagcccagagtgggcaagaccagcctgatcatgagcctggtgagcgaggagttccccgaggaggtgccccccagagccgaggagatcaccatccccgccgacgtgacccccgagagagtgcccacccacatcgtggactacagcgaggccgagcagagcgacgagcagctgcaccaggagatcagccaggccaacgtgatctgcatcgtgtacgccgtgaacaacaagcacagcatcgacaaggtgaccagcagatggatccccctgatcaacgagagaaccgacaaggacagcagactgcccctgatcctggtgggcaacaagagcgacctggtggagtacagcagcatggagaccatcctgcccatcatgaaccagtacaccgagatcgagacctgcgtggagtgcagcgccaagaacctgaagaacatcagcgagctgttctactacgcccagaaggccgtgctgcaccccaccggccccctgtactgccccgaggagaaggagatgaagcccgcctgcatcaaggccctgaccagaatcttcaagatcagcgaccaggacaacgacggcaccctgaacgacgccgagctgaacttcttccagagaatctgcttcaacacccccctggccccccaggccctggaggacgtgaagaacgtggtgagaaagcacatcagcgacggcgtggccgacagcggcctgaccctgaagggcttcctgttcctgcacaccctgttcatccagagaggcagacacgagaccacctggaccgtgctgagaagattcggctacgacgacgacctggacctgacccccgagtacctgttccccctgctgaagatcccccccgactgcaccaccgagctgaaccaccacgcctacctgttcctgcagagcaccttcgacaagcacgacctggacagagactgcgccctgagccccgacgagctgaaggacctgttcaaggtgttcccctacatcccctggggccccgacgtgaacaacaccgtgtgcaccaacgagagaggctggatcacctaccagggcttcctgagccagtggaccctgaccacctacctggacgtgcagagatgcctggagtacctgggctacctgggctacagcatcctgaccgagcaggagagccaggccagcgccgtgaccgtgaccagagacaagaagatcgacctgcagaagaagcagacccagagaaacgtgttcagatgcaacgtgatcggcgtgaagaactgcggcaagagcggcgtgctgcaggccctgctgggcagaaacctgatgagacagaagaagatcagagaggaccacaagagctactacgccatcaacaccgtgtacgtgtacggccaggagaagtacctgctgctgcacgacatcagcgagagcgagttcctgaccgaggccgagatcatctgcgacgtggtgtgcctggtgtacgacgtgagcaaccccaagagcttcgagtactgcgccagaatcttcaagcagcacttcatggacagcagaatcccctgcctgatcgtggccgccaagagcgacctgcacgaggtgaagcaggagtacagcatcagccccaccgacttctgcagaaagcacaagatgccccccccccaggccttcacctgcaacaccgccgacgcccccagcaaggacatcttcgtgaagctgaccaccatggccatgtacccccacgtgacccaggccgacctgaagagcagcaccttctggctgagagccagcttcggcgccaccgtgttcgccgtgctgggcttcgccatgtacaaggccctgctgaagcagagatag

SEQ ID NO: 96416 - DNA, 1980 bp, Artificial Sequence
  Description of Artificial Sequence: Synthetic coding sequence
atgaagaaggacgtgagaatcctgctggtgggcgagcccagagtgggcaagaccagcctgatcatgagcctggtgagcgaggagttccccgaggaggtgccccccagagccgaggagatcaccatccccgccgacgtgacccccgagagagtgcccacccacatcgtggactacagcgaggccgagcagagcgacgagcagctgcaccaggagatcagccaggccaacgtgatctgcatcgtgtacgccgtgaacaacaagcacagcatcgacaaggtgaccagcagatggatccccctgatcaacgagagaaccgacaaggacagcagactgcccctgatcctggtgggcaacaagagcgacctggtggagtacagcagcatggagaccatcctgcccatcatgaaccagtacaccgagatcgagacctgcgtggagtgcagcgccaagaacctgaagaacatcagcgagctgttctactacgcccagaaggccgtgctgcaccccaccggccccctgtactgccccgaggagaaggagatgaagcccgcctgcatcaaggccctgaccagaatcttcaagatcagcgaccaggacaacgacggcaccctgaacgacgccgagctgaacttcttccagagaatctgcttcaacacccccctggccccccaggccctggaggacgtgaagaacgtggtgagaaagcacatcagcgacggcgtggccgacagcggcctgaccctgaagggcttcctgttcctgcacaccctgttcatccagagaggcagacacgagaccacctggaccgtgctgagaagattcggctacgacgacgacctggacctgacccccgagtacctgttccccctgctgaagatcccccccgactgcaccaccgagctgaaccaccacgcctacctgttcctgcagagcaccttcgacaagcacgacctggacagagactgcgccctgagccccgacgagctgaaggacctgttcaaggtgttcccctacatcccctggggccccgacgtgaacaacaccgtgtgcaccaacgagagaggctggatcacctaccagggcttcctgagccagtggaccctgaccacctacctggacgtgcagagatgcctggagtacctgggctacctgggctacagcatcctgaccgagcaggagagccaggccagcgccgtgaccgtgaccagagacaagaagatcgacctgcagaagaagcagacccagagaaacgtgttcagatgcaacgtgatcggcgtgaagaactgcggcaagagcggcgtgctgcaggccctgctgggcagaaacctgatgagacagaagaagatcagagaggaccacaagagctactacgccatcaacaccgtgtacgtgtacggccaggagaagtacctgctgctgcacgacatcagcgagagcgagttcctgaccgaggccgagatcatctgcgacgtggtgtgcctggtgtacgacgtgagcaaccccaagagcttcgagtactgcgccagaatcttcaagcagcacttcatggacagcagaatcccctgcctgatcgtggccgccaagagcgacctgcacgaggtgaagcaggagtacagcatcagccccaccgacttctgcagaaagcacaagatgccccccccccaggccttcacctgcaacaccgccgacgcccccagcaaggacatcttcgtgaagctgaccaccatggccatgtacccccacgccagactgagatgcatgtgcacctgcaacagatgcaccttctgcatctgccagaacttcctgaacagcgacctgctgcagagcgtgaagaacaagatcttcaccgccgtgctgaacagacacgtgacccaggccgacctgaagagcagcaccttctggctgagagccagcttcggcgccaccgtgttcgccgtgctgggcttcgccatgtacaaggccctgctgaagcagagatag

SEQ ID NO: 96417 - DNA, 2076 bp, Artificial Sequence
  Description of Artificial Sequence: Synthetic coding sequence
atgaagaaggacgtgagaatcctgctggtgggcgagcccagagtgggcaagaccagcctgatcatgagcctggtgagcgaggagttccccgaggaggtgccccccagagccgaggagatcaccatccccgccgacgtgacccccgagagagtgcccacccacatcgtggactacagcgaggccgagcagagcgacgagcagctgcaccaggagatcagccaggccaacgtgatctgcatcgtgtacgccgtgaacaacaagcacagcatcgacaaggtgaccagcagatggatccccctgatcaacgagagaaccgacaaggacagcagactgcccctgatcctggtgggcaacaagagcgacctggtggagtacagcagcatggagaccatcctgcccatcatgaaccagtacaccgagatcgagacctgcgtggagtgcagcgccaagaacctgaagaacatcagcgagctgttctactacgcccagaaggccgtgctgcaccccaccggccccctgtactgccccgaggagaaggagatgaagcccgcctgcatcaaggccctgaccagaatcttcaagatcagcgaccaggacaacgacggcaccctgaacgacgccgagctgaacttcttccagagaatctgcttcaacacccccctggccccccaggccctggaggacgtgaagaacgtggtgagaaagcacatcagcgacggcgtggccgacagcggcctgaccctgaagggcttcctgttcctgcacaccctgttcatccagagaggcagacacgagaccacctggaccgtgctgagaagattcggctacgacgacgacctggacctgacccccgagtacctgttccccctgctgaagatcccccccgactgcaccaccgagctgaaccaccacgcctacctgttcctgcagagcaccttcgacaagcacgacctggacagagactgcgccctgagccccgacgagctgaaggacctgttcaaggtgttcccctacatcccctggggccccgacgtgaacaacaccgtgtgcaccaacgagagaggctggatcacctaccagggcttcctgagccagtggaccctgaccacctacctggacgtgcagagatgcctggagtacctgggctacctgggctacagcatcctgaccgagcaggagagccaggccagcgccgtgaccgtgaccagagacaagaagatcgacctgcagaagaagcagacccagagaaacgtgttcagatgcaacgtgatcggcgtgaagaactgcggcaagagcggcgtgctgcaggccctgctgggcagaaacctgatgagacagaagaagatcagagaggaccacaagagctactacgccatcaacaccgtgtacgtgtacggccaggagaagtacctgctgctgcacgacatcagcgagagcgagttcctgaccgaggccgagatcatctgcgacgtggtgtgcctggtgtacgacgtgagcaaccccaagagcttcgagtactgcgccagaatcttcaagcagcacttcatggacagcagaatcccctgcctgatcgtggccgccaagagcgacctgcacgaggtgaagcaggagtacagcatcagccccaccgacttctgcagaaagcacaagatgccccccccccaggccttcacctgcaacaccgccgacgcccccagcaaggacatcttcgtgaagctgaccaccatggccatgtaccccgaggaccactacagagacagactgagcagagacatgggccacaccgacagaatcgagaacctgagaaagatctgggtgttcctgaagaccgccttccacgccagactgagatgcatgtgcacctgcaacagatgcaccttctgcatctgccagaacttcctgaacagcgacctgctgcagagcgtgaagaacaagatcttcaccgccgtgctgaacagacacgtgacccaggccgacctgaagagcagcaccttctggctgagagccagcttcggcgccaccgtgttcgccgtgctgggcttcgccatgtacaaggccctgctgaagcagagatag

SEQ ID NO: 96418 - DNA, 1953 bp, Artificial Sequence
  Description of Artificial Sequence: Synthetic coding sequence
atgaagaaggacgtgagaatcctgctggtgggcgagcccagagtgggcaagaccagcctgatcatgagcctggtgagcgaggagttccccgaggaggtgccccccagagccgaggagatcaccatccccgccgacgtgacccccgagagagtgcccacccacatcgtggactacagcgaggccgagcagagcgacgagcagctgcaccaggagatcagccaggccaacgtgatctgcatcgtgtacgccgtgaacaacaagcacagcatcgacaaggtgaccagcagatggatccccctgatcaacgagagaaccgacaaggacagcagactgcccctgatcctggtgggcaacaagagcgacctggtggagtacagcagcatggagaccatcctgcccatcatgaaccagtacaccgagatcgagacctgcgtggagtgcagcgccaagaacctgaagaacatcagcgagctgttctactacgcccagaaggccgtgctgcaccccaccggccccctgtactgccccgaggagaaggagatgaagcccgcctgcatcaaggccctgaccagaatcttcaagatcagcgaccaggacaacgacggcaccctgaacgacgccgagctgaacttcttccagagaatctgcttcaacacccccctggccccccaggccctggaggacgtgaagaacgtggtgagaaagcacatcagcgacggcgtggccgacagcggcctgaccctgaagggcttcctgttcctgcacaccctgttcatccagagaggcagacacgagaccacctggaccgtgctgagaagattcggctacgacgacgacctggacctgacccccgagtacctgttccccctgctgaagatcccccccgactgcaccaccgagctgaaccaccacgcctacctgttcctgcagagcaccttcgacaagcacgacctggacagagactgcgccctgagccccgacgagctgaaggacctgttcaaggtgttcccctacatcccctggggccccgacgtgaacaacaccgtgtgcaccaacgagagaggctggatcacctaccagggcttcctgagccagtggaccctgaccacctacctggacgtgcagagatgcctggagtacctgggctacctgggctacagcatcctgaccgagcaggagagccaggccagcgccgtgaccgtgaccagagacaagaagatcgacctgcagaagaagcagacccagagaaacgtgttcagatgcaacgtgatcggcgtgaagaactgcggcaagagcggcgtgctgcaggccctgctgggcagaaacctgatgagacagaagaagatcagagaggaccacaagagctactacgccatcaacaccgtgtacgtgtacggccaggagaagtacctgctgctgcacgacatcagcgagagcgagttcctgaccgaggccgagatcatctgcgacgtggtgtgcctggtgtacgacgtgagcaaccccaagagcttcgagtactgcgccagaatcttcaagcagcacttcatggacagcagaatcccctgcctgatcgtggccgccaagagcgacctgcacgaggtgaagcaggagtacagcatcagccccaccgacttctgcagaaagcacaagatgccccccccccaggccttcacctgcaacaccgccgacgcccccagcaaggacatcttcgtgaagctgaccaccatggccatgtaccccgaggaccactacagagacagactgagcagagacatgggccacaccgacagaatcgagaacctgagaaagatctgggtgttcctgaagaccgccctgcacgtgacccaggccgacctgaagagcagcaccttctggctgagagccagcttcggcgccaccgtgttcgccgtgctgggcttcgccatgtacaaggccctgctgaagcagagatag

SEQ ID NO: 96419 - DNA, 744 bp, Artificial Sequence
  Description of Artificial Sequence: Synthetic coding sequence
atgaagaaggacgtgagaatcctgctggtgggcgagcccagagtgggcaagaccagcctgatcatgagcctggtgagcgaggagttccccgaggaggtgccccccagagccgaggagatcaccatccccgccgacgtgacccccgagagagtgcccacccacatcgtggactacagcgaggccgagcagagcgacgagcagctgcaccaggagatcagccaggccaacgtgatctgcatcgtgtacgccgtgaacaacaagcacagcatcgacaaggtgaccagcagatggatccccctgatcaacgagagaaccgacaaggacagcagactgcccctgatcctggtgggcaacaagagcgacctggtggagtacagcagcatggagaccatcctgcccatcatgaaccagtacaccgagatcgagacctgcgtggagtgcagcgccaagaacctgaagaacatcagcgagctgttctactacgcccagaaggccgtgctgcaccccaccggccccctgtactgccccgaggagaaggagatgaagcccgcctgcatcaaggccctgaccagaatcttcaagatcagcgaccaggacaacgacggcaccctgaacgacgccgagctgaacttcttccagagaatctgcttcaacacccccctggcccccagattcggcttcgagcaggtgctggtgctgctgttcctgcagttctgggccctgctgtgcaccaagcactactag

SEQ ID NO: 96420 - DNA, 1857 bp, Artificial Sequence
  Description of Artificial Sequence: Synthetic coding sequence
atgagaagagacgtgagaatcctgctgctgggcgaggcccaggtgggcaagaccagcctgatcctgagcctggtgggcgaggagttccccgaggaggtgccccccagagccgaggagatcaccatccccgccgacgtgacccccgagaaggtgcccacccacatcgtggactacagcgaggccgagcagaccgacgaggagctgagagaggagatccacaaggccaacgtggtgtgcgtggtgtacgacgtgagcgaggaggccaccatcgagaagatcagaaccaagtggatccccctggtgaacggcggcaccacccagggccccagagtgcccatcatcctggtgggcaacaagagcgacctgagaagcggcagcagcatggaggccgtgctgcccatcatgagccagttccccgagatcgagacctgcgtggagtgcagcgccaagaacctgagaaacatcagcgagctgttctactacgcccagaaggccgtgctgcaccccaccgcccccctgtacgaccccgaggccaagcagctgagacccgcctgcgcccaggccctgaccagaatcttcagactgagcgaccaggacctggaccaggccctgagcgacgaggagctgaacgccttccagaagagctgcttcggccaccccctggccccccaggccctggaggacgtgaagaccgtggtgtgcagaaacgtggccggcggcgtgagagaggacagactgaccctggacggcttcctgttcctgaacaccctgttcatccagagaggcagacacgagaccacctggaccatcctgagaagattcggctacagcgacgccctggagctgaccgccgactacctgagccccctgatccacgtgccccccggctgcagcaccgagctgaaccacctgggctaccagttcgtgcagagagtgttcgagaagcacgaccaggacagagacggcgccctgagccccgtggagctgcagagcctgttcagcgtgttccccgccgccccctggggccccgagctgcccagaaccgtgagaaccgaggccggcagactgcccctgcacggctacctgtgccagtggaccctggtgacctacctggacgtgagaagctgcctgggccacctgggctacctgggctaccccaccctgtgcgagcaggaccaggcccacgccatcaccgtgaccagagagaagagactggaccaggagaagggccagacccagagaagcgtgctgctgtgcaaggtggtgggcgccagaggcgtgggcaagagcgccttcctgcaggccttcctgggcagaggcctgggccaccaggacaccagagagcagccccccggctacgccatcgacaccgtgcaggtgaacggccaggagaagtacctgatcctgtgcgaggtgggcaccgacggcctgctggccaccagcctggacgccacctgcgacgtggcctgcctgatgttcgacggcagcgaccccaagagcttcgcccactgcgccagcgtgtacaagcaccactacatggacggccagaccccctgcctgttcgtgagcagcaaggccgacctgcccgagggcgtggccgtgagcggccccagccccgccgagttctgcagaaagcacagactgcccgcccccgtgcccttcagctgcgccggccccgccgagcccagcaccaccatcttcacccagctggccaccatggccgccttcccccacctggtgcacgccgagctgcaccccagcagcttctggctgagaggcctgctgggcgtggtgggcgccgccgtggccgccgtgctgagcttcagcctgtacagagtgctggtgaagagccagtag

SEQ ID NO: 96421 - DNA, 777 bp, Artificial Sequence
  Description of Artificial Sequence: Synthetic coding sequence
atgcccccccagcagggcgaccccgccttccccgacagatgcgaggccccccccgtgccccccagaagagagagaggcggcagaggcggcagaggccccggcgagcccggcggcagaggcagagccggcggcgccgagggcagaggcgtgaagtgcgtgctggtgggcgacggcgccgtgggcaagaccagcctggtggtgagctacaccaccaacggctaccccaccgagtacatccccaccgccttcgacaacttcagcgccgtggtgagcgtggacggcagacccgtgagactgcagctgtgcgacaccgccggccaggacgagttcgacaagctgagacccctgtgctacaccaacaccgacatcttcctgctgtgcttcagcgtggtgagccccagcagcttccagaacgtgagcgagaagtgggtgcccgagatcagatgccactgccccaaggcccccatcatcctggtgggcacccagagcgacctgagagaggacgtgaaggtgctgatcgagctggacaagtgcaaggagaagcccgtgcccgaggaggccgccaagctgtgcgccgaggagatcaaggccgccagctacatcgagtgcagcgccctgacccagaagaacctgaaggaggtgttcgacgccgccatcgtggccggcatccagtacagcgacacccagcagcagcccaagaagagcaagagcagaacccccgacaagatgaagaacctgagcaagagctggtggaagaagtactgctgcttcgtgtag

SEQ ID NO: 96422 - DNA, 1527 bp, Artificial Sequence
  Description of Artificial Sequence: Synthetic coding sequence
atggaccacctgggcgccagcctgtggccccaggtgggcagcctgtgcctgctgctggccggcgccgcctgggcccccccccccaacctgcccgaccccaagttcgagagcaaggccgccctgctggccgccagaggccccgaggagctgctgtgcttcaccgagagactggaggacctggtgtgcttctgggaggaggccgccagcgccggcgtgggccccggcaactacagcttcagctaccagctggaggacgagccctggaagctgtgcagactgcaccaggcccccaccgccagaggcgccgtgagattctggtgcagcctgcccaccgccgacaccagcagcttcgtgcccctggagctgagagtgaccgccgccagcggcgcccccagataccacagagtgatccacatcaacgaggtggtgctgctggacgcccccgtgggcctggtggccagactggccgacgagagcggccacgtggtgctgagatggctgcccccccccgagacccccatgaccagccacatcagatacgaggtggacgtgagcgccggcaacggcgccggcagcgtgcagagagtggagatcctggagggcagaaccgagtgcgtgctgagcaacctgagaggcagaaccagatacaccttcgccgtgagagccagaatggccgagcccagcttcggcggcttctggagcgcctggagcgagcccgtgagcctgctgacccccagcgacctggaccccctgatcctgaccctgagcctgatcctggtggtgatcctggtgctgctgaccgtgctggccctgctgagccacagaagagccctgaagcagaagatctggcccggcatccccagccccgagagcgagttcgagggcctgttcaccacccacaagggcaacttccagctgtggctgtaccagaacgacggctgcctgtggtggagcccctgcacccccttcaccgaggacccccccgccagcctggaggtgctgagcgagagatgctggggcaccatgcaggccgtggagcccggcaccgacgacgagggccccctgctggagcccgtgggcagcgagcacgcccaggacacctacctggtgctggacaagtggctgctgcccagaaacccccccagcgaggacctgcccggccccggcggcagcgtggacatcgtggccatggacgagggcagcgaggccagcagctgcagcagcgccctggccagcaagcccagccccgagggcgccagcgccgccagcttcgagtacaccatcctggaccccagcagccagctgctgagaccctggaccctgtgccccgagctgccccccacccccccccacctgaagtacctgtacctggtggtgagcgacagcggcatcagcaccgactacagcagcggcgacagccagggcgcccagggcggcctgagcgacggcccctacagcaacccctacgagaacagcctgatccccgccgccgagcccctgccccccagctacgtggcctgcagctag

SEQ ID NO: 96423 - DNA, 2550 bp, Artificial Sequence
  Description of Artificial Sequence: Synthetic coding sequence
atggccgccgccgcccccgccgccgccgccgccagcagcgaggcccccgccgccagcgccaccgccgagcccgaggccggcgaccaggacagcagagaggtgagagtgctgcagagcctgagaggcaagatctgcgaggccaagaacctgctgccctacctgggcccccacaagatgagagactgcttctgcaccatcaacctggaccaggaggaggtgtacagaacccaggtggtggagaagagcctgagccccttcttcagcgaggagttctacttcgagatccccagaaccttccagtacctgagcttctacgtgtacgacaagaacgtgctgcagagagacctgagaatcggcaaggtggccatcaagaaggaggacctgtgcaaccacagcggcaaggagacctggttcagcctgcagcccgtggacagcaacagcgaggtgcagggcaaggtgcacctggagctgaagctgaacgagctgatcaccgagaacggcaccgtgtgccagcagctggtggtgcacatcaaggcctgccacggcctgcccctgatcaacggccagagctgcgacccctacgccaccgtgagcctggtgggccccagcagaaacgaccagaagaagaccaaggtgaagaagaagaccagcaacccccagttcaacgagatcttctacttcgaggtgaccagaagcagcagctacaccagaaagagccagttccaggtggaggaggaggacatcgagaagctggagatcagaatcgacctgtggaacaacggcaacctggtgcaggacgtgttcctgggcgagatcaaggtgcccgtgaacgtgctgagaaccgacagcagccaccaggcctggtacctgctgcagcccagagacaacggcaacaagagcagcaagaccgacgacctgggcagcctgagactgaacatctgctacaccgaggactacgtgctgcccagcgagtactacggccccctgaagaccctgctgctgaagagccccgacgtgcagcccatcagcgccagcgccgcctacatcctgagcgagatctgcagagacaagaacgacgccgtgctgcccctggtgagactgctgctgcaccacgacaagctggtgcccttcgccaccgccgtggccgagctggacctgaaggacacccaggacgccaacaccatcttcagaggcaacagcctggccaccagatgcctggacgagatgatgaagatcgtgggcggccactacctgaaggtgaccctgaagcccatcctggacgagatctgcgacagcagcaagagctgcgagatcgaccccatcaagctgaaggagggcgacaacgtggagaacaacaaggagaacctgagatactacgtggacaagctgttcaacaccatcgtgaagagcagcatgagctgccccaccgtgatgtgcgacatcttctacagcctgagacagatggccacccagagattccccaacgacccccacgtgcagtacagcgccgtgagcagcttcgtgttcctgagattcttcgccgtggccgtggtgagcccccacaccttccacctgagaccccaccaccccgacgcccagaccatcagaaccctgaccctgatcagcaagaccatccagaccctgggcagctggggcagcctgagcaagagcaagagcagcttcaaggagaccttcatgtgcgagttcttcaagatgttccaggaggagggctacatcatcgccgtgaagaagttcctggacgagatcagcagcaccgagaccaaggagagcagcggcaccagcgagcccgtgcacctgaaggagggcgagatgtacaagagagcccagggcagaaccagaatcggcaagaagaacttcaagaagagatggttctgcctgaccagcagagagctgacctaccacaagcagcccggcaaggacgccatctacaccatccccgtgaagaacatcctggccgtggagaagctggaggagagcagcttcaacaagaagaacatgttccaggtgatccacaccgagaagcccctgtacgtgcaggccaacaactgcgtggaggccaacgagtggatcgacgtgctgtgcagagtgagcagatgcaaccagaacagactgagcttctaccaccccagcgtgtacctgaacggcaactggctgtgctgccaggagaccggcgagaacaccctgggctgcaagccctgcaccgccggcgtgcccgccgacatccagatcgacatcgacgaggacagagagaccgagagaatctacagcctgttcaccctgagcctgctgaagctgcagaagatggaggaggcctgcggcaccatcgccgtgtaccagggcccccagaaggagcccgacgactacagcaacttcgtgatcgaggacagcgtgaccaccttcaagaccatccagcagatcaagagcatcatcgagaagctggacgagccccacgagaagtacagaaagaagagaagcagcagcgccaagtacggcagcaaggagaaccccatcgtgggcaaggccagctag

SEQ ID NO: 96424 - DNA, 834 bp, Artificial Sequence
  Description of Artificial Sequence: Synthetic coding sequence
atgatgaagatcgtgggcggccactacctgaaggtgaccctgaagcccatcctggacgagatctgcgacagcagcaagagctgcgagatcgaccccatcaagctgaaggagggcgacaacgtggagaacaacaaggagaacctgagatactacgtggacaagctgttcaacaccatcgtgaagagcagcatgagctgccccaccgtgatgtgcgacatcttctacagcctgagacagatggccacccagagattccccaacgacccccacgtgcagtacagcgccgtgagcagcttcgtgttcctgagattcttcgccgtggccgtggtgagcccccacaccttccacctgagaccccaccaccccgacgcccagaccatcagaaccctgaccctgatcagcaagaccatccagaccctgggcagctggggcagcctgagcaagagcaagagcagcttcaaggagaccttcatgtgcgagttcttcaagatgttccaggaggagggctacatcatcgccgtgaagaagttcctggacgagatcagcagcaccgagaccaaggagagcagcggcaccagcgagcccgtgcacctgaaggagggcgagatgtacaagagagcccagggcagaaccagaatcggcaagaagaacttcaagaagagatggttctgcctgaccagcagagagctgacctaccacaagcagcccggcagctgcgtgtacgccctgctgtggggcttcagctggttcagcgtgaaggtgagcctgcccctgatcgtgaccctggtgaaccccttcagcaacatcaccgtggtgtacggcttcagccactag

SEQ ID NO: 96425 - DNA, 2553 bp, Artificial Sequence
  Description of Artificial Sequence: Synthetic coding sequence
atggccgccgccgcccccgccgccgccgccgccagcagcgaggcccccgccgccagcgccaccgccgagcccgaggccggcgaccaggacagcagagaggtgagagtgctgcagagcctgagaggcaagatctgcgaggccaagaacctgctgccctacctgggcccccacaagatgagagactgcttctgcaccatcaacctggaccaggaggaggtgtacagaacccaggtggtggagaagagcctgagccccttcttcagcgaggagttctacttcgagatccccagaaccttccagtacctgagcttctacgtgtacgacaagaacgtgctgcagagagacctgagaatcggcaaggtggccatcaagaaggaggacctgtgcaaccacagcggcaaggagacctggttcagcctgcagcccgtggacagcaacagcgaggtgcagggcaaggtgcacctggagctgaagctgaacgagctgatcaccgagaacggcaccgtgtgccagcagctggtggtgcacatcaaggcctgccacggcctgcccctgatcaacggccagagctgcgacccctacgccaccgtgagcctggtgggccccagcagaaacgaccagaagaagaccaaggtgaagaagaagaccagcaacccccagttcaacgagatcttctacttcgaggtgaccagaagcagcagctacaccagaaagagccagttccaggtggaggaggaggacatcgagaagctggagatcagaatcgacctgtggaacaacggcaacctggtgcaggacgtgttcctgggcgagatcaaggtgcccgtgaacgtgctgagaaccgacagcagccaccaggcctggtacctgctgcagcccagagacaacggcaacaagagcagcaagaccgacgacctgggcagcctgagactgaacatctgctacaccgaggactacgtgctgcccagcgagtactacggccccctgaagaccctgctgctgaagagccccgacgtgcagcccatcagcgccagcgccgcctacatcctgagcgagatctgcagagacaagaacgacgccgtgctgcccctggtgagactgctgctgcaccacgacaagctggtgcccttcgccaccgccgtggccgagctggacctgaaggacacccaggacgccaacaccatcttcagaggcaacagcctggccaccagatgcctggacgagatgatgaagatcgtgggcggccactacctgaaggtgaccctgaagcccatcctggacgagatctgcgacagcagcaagagctgcgagatcgaccccatcaagctgaaggagggcgacaacgtggagaacaacaaggagaacctgagatactacgtggacaagctgttcaacaccatcgtgaagagcagcatgagctgccccaccgtgatgtgcgacatcttctacagcctgagacagatggccacccagagattccccaacgacccccacgtgcagtacagcgccgtgagcagcttcgtgttcctgagattcttcgccgtggccgtggtgagcccccacaccttccacctgagaccccaccaccccgacgcccagaccatcagaaccctgaccctgatcagcaagaccatccagaccctgggcagctggggcagcctgagcaagagcaagagcagcttcaaggagaccttcatgtgcgagttcttcaagatgttccaggaggagggctacatcatcgccgtgaagaagttcctggacgagatcagcagcaccgagaccaaggagagcagcggcaccagcgagcccgtgcacctgaaggagggcgagatgtacaagagagcccagggcagaaccagaatcggcaagaagaacttcaagaagagatggttctgcctgaccagcagagagctgacctaccacaagcagcccggcagcaaggacgccatctacaccatccccgtgaagaacatcctggccgtggagaagctggaggagagcagcttcaacaagaagaacatgttccaggtgatccacaccgagaagcccctgtacgtgcaggccaacaactgcgtggaggccaacgagtggatcgacgtgctgtgcagagtgagcagatgcaaccagaacagactgagcttctaccaccccagcgtgtacctgaacggcaactggctgtgctgccaggagaccggcgagaacaccctgggctgcaagccctgcaccgccggcgtgcccgccgacatccagatcgacatcgacgaggacagagagaccgagagaatctacagcctgttcaccctgagcctgctgaagctgcagaagatggaggaggcctgcggcaccatcgccgtgtaccagggcccccagaaggagcccgacgactacagcaacttcgtgatcgaggacagcgtgaccaccttcaagaccatccagcagatcaagagcatcatcgagaagctggacgagccccacgagaagtacagaaagaagagaagcagcagcgccaagtacggcagcaaggagaaccccatcgtgggcaaggccagctag

SEQ ID NO: 96426 - DNA, 2505 bp, Artificial Sequence
  Description of Artificial Sequence: Synthetic coding sequence
atggccgtggaggacgagggcctgagagtgttccagagcgtgaagatcaagatcggcgaggccaagaacctgcccagctaccccggccccagcaagatgagagactgctactgcaccgtgaacctggaccaggaggaggtgttcagaaccaagatcgtggagaagagcctgtgccccttctacggcgaggacttctactgcgagatccccagaagcttcagacacctgagcttctacatcttcgacagagacgtgttcagaagagacagcatcatcggcaaggtggccatccagaaggaggacctgcagaagtaccacaacagagacacctggttccagctgcagcacgtggacgccgacagcgaggtgcagggcaaggtgcacctggagctgagactgagcgaggtgatcaccgacaccggcgtggtgtgccacaagctggccaccagaatcgtggagtgccagggcctgcccatcgtgaacggccagtgcgacccctacgccaccgtgaccctggccggccccttcagaagcgaggccaagaagaccaaggtgaagagaaagaccaacaacccccagttcgacgaggtgttctacttcgaggtgaccagaccctgcagctacagcaagaagagccacttcgacttcgaggaggaggacgtggacaagctggagatcagagtggacctgtggaacgccagcaacctgaagttcggcgacgagttcctgggcgagctgagaatccccctgaaggtgctgagacagagcagcagctacgaggcctggtacttcctgcagcccagagacaacggcagcaagagcctgaagcccgacgacctgggcagcctgagactgaacgtggtgtacaccgaggaccacgtgttcagcagcgactactacagccccctgagagacctgctgctgaagagcgccgacgtggagcccgtgagcgccagcgccgcccacatcctgggcgaggtgtgcagagagaagcaggaggccgccgtgcccctggtgagactgttcctgcactacggcagagtggtgcccttcatcagcgccatcgccagcgccgaggtgaagagaacccaggaccccaacaccatcttcagaggcaacagcctggccagcaagtgcatcgacgagaccatgaagctggccggcatgcactacctgcacgtgaccctgaagcccgccatcgaggagatctgccagagccacaagccctgcgagatcgaccccgtgaagctgaaggacggcgagaacctggagaacaacatggagaacctgagacagtacgtggacagagtgttccacgccatcaccgagagcggcgtgagctgccccaccgtgatgtgcgacatcttcttcagcctgagagaggccgccgccaagagattccaggacgaccccgacgtgagatacaccgccgtgagcagcttcatcttcctgagattcttcgcccccgccatcctgagccccaacctgttccagctgaccccccaccacaccgacccccagaccagcagaaccctgaccctgatcagcaagaccgtgcagaccctgggcagcctgagcaagagcaagagcgccagcttcaaggagagctacatggccaccttctacgagttcttcaacgagcagaagtacgccgacgccgtgaagaacttcctggacctgatcagcagcagcggcagaagagaccccaagagcgtggagcagcccatcgtgctgaaggagggcttcatgatcaagagagcccagggcagaaagagattcggcatgaagaacttcaagaagagatggttcagactgaccaaccacgagttcacctaccacaagagcaagggcgaccagcccctgtacagcatccccatcgagaacatcctggccgtggagaagctggaggaggagagcttcaagatgaagaacatgttccaggtgatccagcccgagagagccctgtacatccaggccaacaactgcgtggaggccaaggactggatcgacatcctgaccaaggtgagccagtgcaaccagaagagactgaccgtgtaccaccccagcgcctacctgagcggccactggctgtgctgcagagcccccagcgacagcgcccccggctgcagcccctgcaccggcggcctgcccgccaacatccagctggacatcgacggcgacagagagaccgagagaatctacagcctgttcaacctgtacatgagcaagctggagaagatgcaggaggcctgcggcagcaagagcgtgtacgacggccccgagcaggaggagtacagcaccttcgtgatcgacgacccccaggagacctacaagaccctgaagcaggtgatcgccggcgtgggcgccctggagcaggagcacgcccagtacaagagagacaagttcaagaagaccaagtacggcagccaggagcaccccatcggcgacaagagcttccagaactacatcagacagcagagcgagaccagcacccacagcatctag

SEQ ID NO: 96427 - DNA, 2409 bp, Artificial Sequence
  Description of Artificial Sequence: Synthetic coding sequence
atgagagactgctactgcaccgtgaacctggaccaggaggaggtgttcagaaccaagatcgtggagaagagcctgtgccccttctacggcgaggacttctactgcgagatccccagaagcttcagacacctgagcttctacatcttcgacagagacgtgttcagaagagacagcatcatcggcaaggtggccatccagaaggaggacctgcagaagtaccacaacagagacacctggttccagctgcagcacgtggacgccgacagcgaggtgcagggcaaggtgcacctggagctgagactgagcgaggtgatcaccgacaccggcgtggtgtgccacaagctggccaccagaatcgtggagtgccagggcctgcccatcgtgaacggccagtgcgacccctacgccaccgtgaccctggccggccccttcagaagcgaggccaagaagaccaaggtgaagagaaagaccaacaacccccagttcgacgaggtgttctacttcgaggtgaccagaccctgcagctacagcaagaagagccacttcgacttcgaggaggaggacgtggacaagctggagatcagagtggacctgtggaacgccagcaacctgaagttcggcgacgagttcctgggcgagctgagaatccccctgaaggtgctgagacagagcagcagctacgaggcctggtacttcctgcagcccagagacaacggcagcaagagcctgaagcccgacgacctgggcagcctgagactgaacgtggtgtacaccgaggaccacgtgttcagcagcgactactacagccccctgagagacctgctgctgaagagcgccgacgtggagcccgtgagcgccagcgccgcccacatcctgggcgaggtgtgcagagagaagcaggaggccgccgtgcccctggtgagactgttcctgcactacggcagagtggtgcccttcatcagcgccatcgccagcgccgaggtgaagagaacccaggaccccaacaccatcttcagaggcaacagcctggccagcaagtgcatcgacgagaccatgaagctggccggcatgcactacctgcacgtgaccctgaagcccgccatcgaggagatctgccagagccacaagccctgcgagatcgaccccgtgaagctgaaggacggcgagaacctggagaacaacatggagaacctgagacagtacgtggacagagtgttccacgccatcaccgagagcggcgtgagctgccccaccgtgatgtgcgacatcttcttcagcctgagagaggccgccgccaagagattccaggacgaccccgacgtgagatacaccgccgtgagcagcttcatcttcctgagattcttcgcccccgccatcctgagccccaacctgttccagctgaccccccaccacaccgacccccagaccagcagaaccctgaccctgatcagcaagaccgtgcagaccctgggcagcctgagcaagagcaagagcgccagcttcaaggagagctacatggccaccttctacgagttcttcaacgagcagaagtacgccgacgccgtgaagaacttcctggacctgatcagcagcagcggcagaagagaccccaagagcgtggagcagcccatcgtgctgaaggagggcttcatgatcaagagagcccagggcagaaagagattcggcatgaagaacttcaagaagagatggttcagactgaccaaccacgagttcacctaccacaagagcaagggcgaccagcccctgtacagcatccccatcgagaacatcctggccgtggagaagctggaggaggagagcttcaagatgaagaacatgttccaggtgatccagcccgagagagccctgtacatccaggccaacaactgcgtggaggccaaggactggatcgacatcctgaccaaggtgagccagtgcaaccagaagagactgaccgtgtaccaccccagcgcctacctgagcggccactggctgtgctgcagagcccccagcgacagcgcccccggctgcagcccctgcaccggcggcctgcccgccaacatccagctggacatcgacggcgacagagagaccgagagaatctacagcctgttcaacctgtacatgagcaagctggagaagatgcaggaggcctgcggcagcaagagcgtgtacgacggccccgagcaggaggagtacagcaccttcgtgatcgacgacccccaggagacctacaagaccctgaagcaggtgatcgccggcgtgggcgccctggagcaggagcacgcccagtacaagagagacaagttcaagaagaccaagtacggcagccaggagcaccccatcggcgacaagagcttccagaactacatcagacagcagagcgagaccagcacccacagcatctag

SEQ ID NO: 96428 - DNA, 399 bp, Artificial Sequence
  Description of Artificial Sequence: Synthetic coding sequence
atggccgtggaggacgagggcctgagagtgttccagagcgtgaagatcaagatcggcgaggccaagaacctgcccagctaccccggccccagcaagatgagagactgctactgcaccgtgaacctggaccaggaggaggtgttcagaaccaagatcgtggagaagagcctgtgccccttctacggcgaggacttctactgcgagatccccagaagcttcagacacctgagcttctacatcttcgacagagacgtgttcagaagagacagcatcatcggccagagcgcccccggcgccgccgccgagagaggccaccacagacactggggcagactgccccaggccagacacacccacagaagagtgcccggccccccccacagagagtgggccatgtag

SEQ ID NO: 96429 - DNA, 2412 bp, Artificial Sequence
  Description of Artificial Sequence: Synthetic coding sequence
atggccaagagaagcagcctgtacatcagaatcgtggagggcaagaacctgcccgccaaggacatcaccggcagcagcgacccctactgcatcgtgaaggtggacaacgagcccatcatcagaaccgccaccgtgtggaagaccctgtgccccttctggggcgaggagtaccaggtgcacctgccccccaccttccacgccgtggccttctacgtgatggacgaggacgccctgagcagagacgacgtgatcggcaaggtgtgcctgaccagagacaccatcgccagccaccccaagggcttcagcggctgggcccacctgaccgaggtggaccccgacgaggaggtgcagggcgagatccacctgagactggaggtgtggcccggcgccagagcctgcagactgagatgcagcgtgctggaggccagagacctggcccccaaggacagaaacggcaccagcgaccccttcgtgagagtgagatacaagggcagaaccagagagaccagcatcgtgaagaagagctgctaccccagatggaacgagaccttcgagttcgagctgcaggagggcgccatggaggccctgtgcgtggaggcctgggactgggacctggtgagcagaaacgacttcctgggcaaggtggtgatcgacgtgcagagactgagagtggtgcagcaggaggagggctggttcagactgcagcccgaccagagcaagagcagaagacacgacgagggcaacctgggcagcctgcagctggaggtgagactgagagacgagaccgtgctgcccagcagctactaccagcccctggtgcacctgctgtgccacgaggtgaagctgggcatgcagggccccggccagctgatccccctgatcgaggagaccaccagcaccgagtgcagacaggacgtggccaccaacctgctgaagctgttcctgggccagggcctggccaaggacttcctggacctgctgttccagctggagctgagcagaaccagcgagaccaacaccctgttcagaagcaacagcctggccagcaagagcatggagagcttcctgaaggtggccggcatgcagtacctgcacggcgtgctgggccccatcatcaacaaggtgttcgaggagaagaagtacgtggagctggaccccagcaaggtggaggtgaaggacgtgggctgcagcggcctgcacagaccccagaccgaggccgaggtgctggagcagagcgcccagaccctgagagcccacctgggcgccctgctgagcgccctgagcagaagcgtgagagcctgccccgccgtggtgagagccaccttcagacagctgttcagaagagtgagagagagattccccggcgcccagcacgagaacgtgcccttcatcgccgtgaccagcttcctgtgcctgagattcttcagccccgccatcatgagccccaagctgttccacctgagagagagacacgccgacgccagaaccagcagaaccctgctgctgctggccaaggccgtgcagaacgtgggcaacatggacacccccgccagcagagccaaggaggcctggatggagcccctgcagcccaccgtgagacagggcgtggcccagctgaaggacttcatcaccaagctggtggacatcgaggagaaggacgagctggacctgcagagaaccctgagcctgcaggccccccccgtgaaggagggccccctgttcatccacagaaccaagggcaagggccccctgatgagcagcagcttcaagaagctgtacttcagcctgaccaccgaggccctgagcttcgccaagacccccagcagcaagaagagcgccctgatcaagctggccaacatcagagccgccgagaaggtggaggagaagagcttcggcggcagccacgtgatgcaggtgatctacaccgacgacgccggcagaccccagaccgcctacctgcagtgcaagtgcgtgaacgagctgaaccagtggctgagcgccctgagaaaggtgagcatcaacaacaccggcctgctgggcagctaccaccccggcgtgttcagaggcgacaagtggagctgctgccaccagaaggagaagaccggccagggctgcgacaagaccagaagcagagtgaccctgcaggagtggaacgaccccctggaccacgacctggaggcccagctgatctacagacacctgctgggcgtggaggccatgctgtgggagagacacagagagctgagcggcggcgccgaggccggcaccgtgcccaccagccccggcaaggtgcccgaggacagcctggccagactgctgagagtgctgcaggacctgagagaggcccacagcagcagccccgccggcagcccccccagcgagcccaactgcctgctggagctgcagacctag

SEQ ID NO: 96430 - DNA, 2274 bp, Artificial Sequence
  Description of Artificial Sequence: Synthetic coding sequence
atggccaagagaagcagcctgtacatcagaatcgtggagggcaagaacctgcccgccaaggacatcaccggcagcagcgacccctactgcatcgtgaaggtggacaacgagcccatcatcagaaccgccaccgtgtggaagaccctgtgccccttctggggcgaggagtaccaggtgcacctgccccccaccttccacgccgtggccttctacgtgatggacgaggacgccctgagcagagacgacgtgatcggcaaggtgtgcctgaccagagacaccatcgccagccaccccaagggcttcagcggctgggcccacctgaccgaggtggaccccgacgaggaggtgcagggcgagatccacctgagactggaggtgtggcccggcgccagagcctgcagactgagatgcagcgtgctggaggccagagacctggcccccaaggacagaaacggcaccagcgaccccttcgtgagagtgagatacaagggcagaaccagagagaccagcatcgtgaagaagagctgctaccccagatggaacgagaccttcgagttcgagctgcaggagggcgccatggaggccctgtgcgtggaggcctgggactgggacctggtgagcagaaacgacttcctgggcaaggtggtgatcgacgtgcagagactgagagtggtgcagcaggaggagggctggttcagactgcagcccgaccagagcaagagcagaagacacgacgagggcaacctgggcagcctgcagctggaggtgagactgagagacgagaccgtgctgcccagcagctactaccagcccctggtgcacctgctgtgccacgaggtgaagctgggcatgcagggccccggccagctgatccccctgatcgaggagaccaccagcaccgagtgcagacaggacgtggccaccaacctgctgaagctgttcctgggccagggcctggccaaggacttcctggacctgctgttccagctggagctgagcagaaccagcgagaccaacaccctgttcagaagcaacagcctggccagcaagagcatggagagcttcctgaaggtggccggcatgcagtacctgcacggcgtgctgggccccatcatcaacaaggtgttcgaggagaagaagtacgtggagctggaccccagcaaggtggaggtgaaggacgtgggctgcagcggcctgcacagaccccagaccgaggccgaggtgctggagcagagcgcccagaccctgagagcccacctgggcgccctgctgagcgccctgagcagaagcgtgagagcctgccccgccgtggtgagagccaccttcagacagctgttcagaagagtgagagagagattccccggcgcccagcacgagaacgtgcccttcatcgccgtgaccagcttcctgtgcctgagattcttcagccccgccatcatgagccccaagctgttccacctgagagagagacacgccgacgccagaaccagcagaaccctgctgctgctggccaaggccgtgcagaacgtgggcaacatggacacccccgccagcagagccaaggaggcctggatggagcccctgcagcccaccgtgagacagggcgtggcccagctgaaggacttcatcaccaagctggtggacatcgaggagaaggacgagctggacctgcagagaaccctgagcctgcaggccccccccgtgaaggagggccccctgttcatccacagaaccaagggcaagggccccctgatgagcagcagcttcaagaagctgtacttcagcctgaccaccgaggccctgagcttcgccaagacccccagcagcaagtgcgtgaacgagctgaaccagtggctgagcgccctgagaaaggtgagcatcaacaacaccggcctgctgggcagctaccaccccggcgtgttcagaggcgacaagtggagctgctgccaccagaaggagaagaccggccagggctgcgacaagaccagaagcagagtgaccctgcaggagtggaacgaccccctggaccacgacctggaggcccagctgatctacagacacctgctgggcgtggaggccatgctgtgggagagacacagagagctgagcggcggcgccgaggccggcaccgtgcccaccagccccggcaaggtgcccgaggacagcctggccagactgctgagagtgctgcaggacctgagagaggcccacagcagcagccccgccggcagcccccccagcgagcccaactgcctgctggagctgcagacctag

SEQ ID NO: 96431 - DNA, 2196 bp, Artificial Sequence
  Description of Artificial Sequence: Synthetic coding sequence
atggacgaggacgccctgagcagagacgacgtgatcggcaaggtgtgcctgaccagagacaccatcgccagccaccccaagggcttcagcggctgggcccacctgaccgaggtggaccccgacgaggaggtgcagggcgagatccacctgagactggaggtgtggcccggcgccagagcctgcagactgagatgcagcgtgctggaggccagagacctggcccccaaggacagaaacggcaccagcgaccccttcgtgagagtgagatacaagggcagaaccagagagaccagcatcgtgaagaagagctgctaccccagatggaacgagaccttcgagttcgagctgcaggagggcgccatggaggccctgtgcgtggaggcctgggactgggacctggtgagcagaaacgacttcctgggcaaggtggtgatcgacgtgcagagactgagagtggtgcagcaggaggagggctggttcagactgcagcccgaccagagcaagagcagaagacacgacgagggcaacctgggcagcctgcagctggaggtgagactgagagacgagaccgtgctgcccagcagctactaccagcccctggtgcacctgctgtgccacgaggtgaagctgggcatgcagggccccggccagctgatccccctgatcgaggagaccaccagcaccgagtgcagacaggacgtggccaccaacctgctgaagctgttcctgggccagggcctggccaaggacttcctggacctgctgttccagctggagctgagcagaaccagcgagaccaacaccctgttcagaagcaacagcctggccagcaagagcatggagagcttcctgaaggtggccggcatgcagtacctgcacggcgtgctgggccccatcatcaacaaggtgttcgaggagaagaagtacgtggagctggaccccagcaaggtggaggtgaaggacgtgggctgcagcggcctgcacagaccccagaccgaggccgaggtgctggagcagagcgcccagaccctgagagcccacctgggcgccctgctgagcgccctgagcagaagcgtgagagcctgccccgccgtggtgagagccaccttcagacagctgttcagaagagtgagagagagattccccggcgcccagcacgagaacgtgcccttcatcgccgtgaccagcttcctgtgcctgagattcttcagccccgccatcatgagccccaagctgttccacctgagagagagacacgccgacgccagaaccagcagaaccctgctgctgctggccaaggccgtgcagaacgtgggcaacatggacacccccgccagcagagccaaggaggcctggatggagcccctgcagcccaccgtgagacagggcgtggcccagctgaaggacttcatcaccaagctggtggacatcgaggagaaggacgagctggacctgcagagaaccctgagcctgcaggccccccccgtgaaggagggccccctgttcatccacagaaccaagggcaagggccccctgatgagcagcagcttcaagaagctgtacttcagcctgaccaccgaggccctgagcttcgccaagacccccagcagcaagaagagcgccctgatcaagctggccaacatcagagccgccgagaaggtggaggagaagagcttcggcggcagccacgtgatgcaggtgatctacaccgacgacgccggcagaccccagaccgcctacctgcagtgcaagtgcgtgaacgagctgaaccagtggctgagcgccctgagaaaggtgagcatcaacaacaccggcctgctgggcagctaccaccccggcgtgttcagaggcgacaagtggagctgctgccaccagaaggagaagaccggccagggctgcgacaagaccagaagcagagtgaccctgcaggagtggaacgaccccctggaccacgacctggaggcccagctgatctacagacacctgctgggcgtggaggccatgctgtgggagagacacagagagctgagcggcggcgccgaggccggcaccgtgcccaccagccccggcaaggtgcccgaggacagcctggccagactgctgagagtgctgcaggacctgagagaggcccacagcagcagccccgccggcagcccccccagcgagcccaactgcctgctggagctgcagacctag

SEQ ID NO: 96432 - DNA, 2415 bp, Artificial Sequence
  Description of Artificial Sequence: Synthetic coding sequence
atggccaagagcagcagcctgaacgtgagagtggtggagggcagagccctgcccgccaaggacgtgagcggcagcagcgacccctactgcctggtgaaggtggacgacgaggtggtggccagaaccgccaccgtgtggagaagcctgggccccttctggggcgaggagtacaccgtgcacctgcccctggacttccaccagctggccttctacgtgctggacgaggacaccgtgggccacgacgacatcatcggcaagatcagcctgagcagagaggccatcaccgccgaccccagaggcatcgacagctggatcaacctgagcagagtggaccccgacgccgaggtgcagggcgagatctgcctgagcgtgcagatgctggaggacggccagggcagatgcctgagatgccacgtgctgcaggccagagacctggcccccagagacatcagcggcaccagcgaccccttcgccagagtgttctggggcagccagagcctggagaccagcaccatcaagaagaccagattcccccactgggacgaggtgctggagctgagagagatgcccggcgcccccagccccctgagagtggagctgtgggactgggacatggtgggcaagaacgacttcctgggcatggtggagttcagccccaagaccctgcagcagaagccccccaagggctggttcagactgctgcccttccccagagccgaggaggacagcggcggcaacctgggcgccctgagagtgaaggtgagactgatcgaggacagagtgctgcccagccagtgctaccagcccctgatggagctgctgatggagagcgtgcagggccccgccgaggaggacaccgccagccccctggccctgctggaggagctgaccctgggcgactgcagacaggacctggccaccaagctggtgaagctgttcctgggcagaggcctggccggcagattcctggactacctgaccagaagagaggtggccagaaccatggaccccaacaccctgttcagaagcaacagcctggccagcaagagcatggagcagttcatgaagctggtgggcatgccctacctgcacgaggtgctgaagcccgtgatcagcagagtgttcgaggagaagaagtacatggagctggacccctgcaagatggacctgggcagaaccagaagaatcagcttcaagggcgccctgagcgaggagcagatgagagagaccagcctgggcctgctgaccggctacctgggccccatcgtggacgccatcgtgggcagcgtgggcagatgcccccccgccatgagactggccttcaagcagctgcacagaagagtggaggagagattcccccaggccgagcaccaggacgtgaagtacctggccatcagcggcttcctgttcctgagattcttcgcccccgccatcctgacccccaagctgttcgacctgagagaccagcacgccgacccccagaccagcagaagcctgctgctgctggccaaggccgtgcagagcatcggcaacctgggccagcagctgggccagggcaaggagctgtggatggcccccctgcaccccttcctgctgcagtgcgtgagcagagtgagagacttcctggacagactggtggacgtggacggcgacgaggccggcgtgcccgccagagccctgttcccccccagcgccatcgtgagagagggctacctgctgaagagaaaggaggagcccgccggcctggccaccagattcgccttcaagaagagatacgtgtggctgagcggcgagaccctgagcttcagcaagagccccgagtggcagatgtgccacagcatccccgtgagccacatcagagccgtggagagagtggacgagggcgccttccagctgccccacgtgatgcaggtggtgacccaggacggcaccggcgccctgcacaccacctacctgcagtgcaagaacgtgaacgagctgaaccagtggctgagcgccctgagaaaggccagcgcccccaaccccaacaagctggccgcctgccaccccggcgccttcagaagcgccagatggacctgctgcctgcaggccgagagaagcgccgccggctgcagcagaacccacagcgccgtgaccctgggcgactggagcgaccccctggaccccgacgccgaggcccagaccgtgtacagacagctgctgctgggcagagaccagctgagactgaagctgctggaggacagcaacatggacaccaccctggaggccgacaccggcgcctgccccgaggtgctggccagacagagagccgccaccgccagactgctggaggtgctggccgacctggacagagcccacgaggagttccagcagcaggagagaggcaaggccgccctgggccccctgggcccctag

SEQ ID NO: 96433 - DNA, 2331 bp, Artificial Sequence
  Description of Artificial Sequence: Synthetic coding sequence
atggccaagagcagcagcctgaacgtgagagtggtggagggcagagccctgcccgccaaggacgtgagcggcagcagcgacccctactgcctggtgaaggtggacgacgaggtggtggccagaaccgccaccgtgtggagaagcctgggccccttctggggcgaggagtacaccgtgcacctgcccctggacttccaccagctggccttctacgtgctggacgaggacaccgtgggccacgacgacatcatcggcaagatcagcctgagcagagaggccatcaccgccgaccccagaggcatcgacagctggatcaacctgagcagagtggaccccgacgccgaggtgcagggcgagatctgcctgagcgtgcagatgctggaggacggccagggcagatgcctgagatgccacgtgctgcaggccagagacctggcccccagagacatcagcggcaccagcgaccccttcgccagagtgttctggggcagccagagcctggagaccagcaccatcaagaagaccagattcccccactgggacgaggtgctggagctgagagagatgcccggcgcccccagccccctgagagtggagctgtgggactgggacatggtgggcaagaacgacttcctgggcatggtggagttcagccccaagaccctgcagcagaagccccccaagggctggttcagactgctgcccttccccagagccgaggaggacagcggcggcaacctgggcgccctgagagtgaaggtgagactgatcgaggacagagtgctgcccagccagtgctaccagcccctgatggagctgctgatggagagcgtgcagggccccgccgaggaggacaccgccagccccctggccctgctggaggagctgaccctgggcgactgcagacaggacctggccaccaagctggtgaagctgttcctgggcagaggcctggccggcagattcctggactacctgaccagaagagaggtggccagaaccatggaccccaacaccctgttcagaagcaacagcctggccagcaagagcatggagcagttcatgaagctggtgggcatgccctacctgcacgaggtgctgaagcccgtgatcagcagagtgttcgaggagaagaagtacatggagctggacccctgcaagatggacctgggcagaaccagaagaatcagcttcaagggcgccctgagcgaggagcagatgagagagaccagcctgggcctgctgaccggctacctgggccccatcgtggacgccatcgtgggcagcgtgggcagatgcccccccgccatgagactggccttcaagcagctgcacagaagagtggaggagagattcccccaggccgagcaccaggacgtgaagtacctggccatcagcggcttcctgttcctgagattcttcgcccccgccatcctgacccccaagctgttcgacctgagagaccagcacgccgacccccagaccagcagaagcctgctgctgctggccaaggccgtgcagagcatcggcaacctgggccagcagctgggccagggcaaggagctgtggatggcccccctgcaccccttcctgctgcagtgcgtgagcagagtgagagacttcctggacagactggtggacgtggacggcgacgaggccggcgtgcccgccagagccctgttcccccccagcgccatcgtgagagagggctacctgctgaagagaaaggaggagcccgccggcctggccaccagattcgccttcaagaagagatacgtgtggctgagcggcgagaccctgagcttcagcaagagccccgagtggcaggtggtgacccaggacggcaccggcgccctgcacaccacctacctgcagtgcaagaacgtgaacgagctgaaccagtggctgagcgccctgagaaaggccagcgcccccaaccccaacaagctggccgcctgccaccccggcgccttcagaagcgccagatggacctgctgcctgcaggccgagagaagcgccgccggctgcagcagaacccacagcgccgtgaccctgggcgactggagcgaccccctggaccccgacgccgaggcccagaccgtgtacagacagctgctgctgggcagagaccagctgagactgaagctgctggaggacagcaacatggacaccaccctggaggccgacaccggcgcctgccccgaggtgctggccagacagagagccgccaccgccagactgctggaggtgctggccgacctggacagagcccacgaggagttccagcagcaggagagaggcaaggccgccctgggccccctgggcccctag

SEQ ID NO: 96434 - DNA, 2421 bp, Artificial Sequence
  Description of Artificial Sequence: Synthetic coding sequence
atggccaagagcagcagcctgaacgtgagagtggtggagggcagagccctgcccgccaaggacgtgagcggcagcagcgacccctactgcctggtgaaggtggacgacgaggtggtggccagaaccgccaccgtgtggagaagcctgggccccttctggggcgaggagtacaccgtgcacctgcccctggacttccaccagctggccttctacgtgctggacgaggacaccgtgggccacgacgacatcatcggcaagatcagcctgagcagagaggccatcaccgccgaccccagaggcatcgacagctggatcaacctgagcagagtggaccccgacgccgaggtgcagggcgagatctgcctgagcgtgcagatgctggaggacggccagggcagatgcctgagatgccacgtgctgcaggccagagacctggcccccagagacatcagcggcaccagcgaccccttcgccagagtgttctggggcagccagagcctggagaccagcaccatcaagaagaccagattcccccactgggacgaggtgctggagctgagagagatgcccggcgcccccagccccctgagagtggagctgtgggactgggacatggtgggcaagaacgacttcctgggcatggtggagttcagccccaagaccctgcagcagaagccccccaagggctggttcagactgctgcccttccccagagccgaggaggacagcggcggcaacctgggcgccctgagagtgaaggtgagactgatcgaggacagagtgctgcccagccagtgctaccagcccctgatggagctgctgatggagagcgtgcagggccccgccgaggaggacaccgccagccccctggccctgctggaggagctgaccctgggcgactgcagacaggacctggccaccaagctggtgaagctgttcctgggcagaggcctggccggcagattcctggactacctgaccagaagagaggtggccagaaccatggaccccaacaccctgttcagaagcaacagcctggccagcaagagcatggagcagttcatgaagctggtgggcatgccctacctgcacgaggtgctgaagcccgtgatcagcagagtgttcgaggagaagaagtacatggagctggacccctgcaagatggacctgggcagaaccagaagaatcagcttcaagggcgccctgagcgaggagcagatgagagagaccagcctgggcctgctgaccggctacctgggccccatcgtggacgccatcgtgggcagcgtgggcagatgcccccccgccatgagactggccttcaagcagctgcacagaagagtggaggagagattcccccaggccgagcaccagcaggacgtgaagtacctggccatcagcggcttcctgttcctgagattcttcgcccccgccatcctgacccccaagctgttcgacctgagagaccagcacgccgacccccagaccagcagaagcctgctgctgctggccaaggccgtgcagagcatcggcaacctgggccagcagctgggccagggcaaggagctgtggatggcccccctgcaccccttcctgctgcagtgcgtgagcagagtgagagacttcctggacagactggtggacgtggacggcgacgaggaggccggcgtgcccgccagagccctgttcccccccagcgccatcgtgagagagggctacctgctgaagagaaaggaggagcccgccggcctggccaccagattcgccttcaagaagagatacgtgtggctgagcggcgagaccctgagcttcagcaagagccccgagtggcagatgtgccacagcatccccgtgagccacatcagagccgtggagagagtggacgagggcgccttccagctgccccacgtgatgcaggtggtgacccaggacggcaccggcgccctgcacaccacctacctgcagtgcaagaacgtgaacgagctgaaccagtggctgagcgccctgagaaaggccagcgcccccaaccccaacaagctggccgcctgccaccccggcgccttcagaagcgccagatggacctgctgcctgcaggccgagagaagcgccgccggctgcagcagaacccacagcgccgtgaccctgggcgactggagcgaccccctggaccccgacgccgaggcccagaccgtgtacagacagctgctgctgggcagagaccagctgagactgaagctgctggaggacagcaacatggacaccaccctggaggccgacaccggcgcctgccccgaggtgctggccagacagagagccgccaccgccagactgctggaggtgctggccgacctggacagagcccacgaggagttccagcagcaggagagaggcaaggccgccctgggccccctgggcccctag

SEQ ID NO: 96435 - DNA, 3714 bp, Artificial Sequence
  Description of Artificial Sequence: Synthetic coding sequence
atgcagaagagcgtgagatacaacgagggccacgccctgtacctggccttcctggccagaaaggagggcaccaagagaggcttcctgagcaagaagaccgccgaggccagcagatggcacgagaagtggttcgccctgtaccagaacgtgctgttctacttcgagggcgagcagagctgcagacccgccggcatgtacctgctggagggctgcagctgcgagagaacccccgccccccccagagccggcgccggccagggcggcgtgagagacgccctggacaagcagtactacttcaccgtgctgttcggccacgagggccagaagcccctggagctgagatgcgaggaggagcaggacggcaaggagtggatggaggccatccaccaggccagctacgccgacatcctgatcgagagagaggtgctgatgcagaagtacatccacctggtgcagatcgtggagaccgagaagatcgccgccaaccagctgagacaccagctggaggaccaggacaccgagatcgagagactgaagagcgagatcatcgccctgaacaagaccaaggagagaatgagaccctaccagagcaaccaggaggacgaggaccccgacatcaagaagatcaagaaggtgcagagcttcatgagaggctggctgtgcagaagaaagtggaagaccatcgtgcaggactacatctgcagcccccacgccgagagcatgagaaagagaaaccagatcgtgttcaccatggtggaggccgagagcgagtacgtgcaccagctgtacatcctggtgaacggcttcctgagacccctgagaatggccgccagcagcaagaagccccccatcagccacgacgacgtgagcagcatcttcctgaacagcgagaccatcatgttcctgcacgagatcttccaccagggcctgaaggccagaatcgccaactggcccaccctgatcctggccgacctgttcgacatcctgctgcccatgctgaacatctaccaggagttcgtgagaaaccaccagtacagcctgcaggtgctggccaactgcaagcagaacagagacttcgacaagctgctgaagcagtacgaggccaaccccgcctgcgagggcagaatgctggagaccttcctgacctaccccatgttccagatccccagatacatcatcaccctgcacgagctgctggcccacaccccccacgagcacgtggagagaaagagcctggagttcgccaagagcaagctggaggagctgagcagagtgatgcacgacgaggtgagcgacaccgagaacatcagaaagaacctggccatcgagagaatgatcgtggagggctgcgacatcctgctggacaccagccagaccttcatcagacagggcagcctgatccaggtgcccagcgtggagagaggcaagctgagcaaggtgagactgggcagcctgagcctgaagaaggagggcgagagacagtgcttcctgttcaccaagcacttcctgatctgcaccagaagcagcggcggcaagctgcacctgctgaagaccggcggcgtgctgagcctgatcgactgcaccctgatcgaggagcccgacgccagcgacgacgacagcaagggcagcggccaggtgttcggccacctggacttcaagatcgtggtggagccccccgacgccgccgccttcaccgtggtgctgctggcccccagcagacaggagaaggccgcctggatgagcgacatcagccagtgcgtggacaacatcagatgcaacggcctgatgaccatcgtgttcgaggagaacagcaaggtgaccgtgccccacatgatcaagagcgacgccagactgcacaaggacgacaccgacatctgcttcagcaagaccctgaacagctgcaaggtgccccagatcagatacgccagcgtggagagactgctggagagactgaccgacctgagattcctgagcatcgacttcctgaacaccttcctgcacacctacagaatcttcaccaccgccgccgtggtgctgggcaagctgagcgacatctacaagagacccttcaccagcatccccgtgagaagcctggagctgttcttcgccaccagccagaacaacagaggcgagcacctggtggacggcaagagccccagactgtgcagaaagttcagcagccccccccccctggccgtgagcagaaccagcagccccgtgagagccagaaagctgagcctgaccagccccctgaacagcaagatcggcgccctggacctgaccaccagcagcagccccaccaccaccacccagagccccgccgccagcccccccccccacaccggccagatccccctggacctgagcagaggcctgagcagccccgagcagagccccggcaccgtggaggagaacgtggacaaccccagagtggacctgtgcaacaagctgaagagaagcatccagaaggccgtgctggagagcgcccccgccgacagagccggcgtggagagcagccccgccgccgacaccaccgagctgagcccctgcagaagccccagcacccccagacacctgagatacagacagcccggcggccagaccgccgacaacgcccactgcagcgtgagccccgccagcgccttcgccatcgccaccgccgccgccggccacggcagcccccccggcttcaacaacaccgagagaacctgcgacaaggagttcatcatcagaagaaccgccaccaacagagtgctgaacgtgctgagacactgggtgagcaagcacgcccaggacttcgagctgaacaacgagctgaagatgaacgtgctgaacctgctggaggaggtgctgagagaccccgacctgctgccccaggagagaaaggccgccgccaacatcctgagagccctgagccaggacgaccaggacgacatccacctgaagctggaggacatcatccagatgaccgactgcatgaaggccgagtgcttcgagagcctgagcgccatggagctggccgagcagatcaccctgctggaccacgtgatcttcagaagcatcccctacgaggagttcctgggccagggctggatgaagctggacaagaacgagagaaccccctacatcatgaagaccagccagcacttcaacgacatgagcaacctggtggccagccagatcatgaactacgccgacgtgagcagcagagccaacgccatcgagaagtgggtggccgtggccgacatctgcagatgcctgcacaactacaacggcgtgctggagatcaccagcgccctgaacagaagcgccatctacagactgaagaagacctgggccaaggtgagcaagcagaccaaggccctgatggacaagctgcagaagaccgtgagcagcgagggcagattcaagaacctgagagagaccctgaagaactgcaacccccccgccgtgccctacctgggcatgtacctgaccgacctggccttcatcgaggagggcacccccaacttcaccgaggagggcctggtgaacttcagcaagatgagaatgatcagccacatcatcagagagatcagacagttccagcagaccagctacagaatcgaccaccagcccaaggtggcccagtacctgctggacaaggacctgatcatcgacgaggacaccctgtacgagctgagcctgaagatcgagcccagactgcccgcctag

SEQ ID NO: 96436 - DNA, 4431 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccaccaacggcaacatgcacagacacatgaagatccacgagaaggaccccaacagcgccaccgccaccgccccccccagccccctgaagagaagaagactgagcagcaagagaaagctgagccacgacgccgagagcgagagagaggaccccgcccccgccaagaagatggtggaggacggccagagcggcgacctggagaagaaggccgacgaggtgttccactgccccgtgtgcttcaaggagttcgtgtgcaagtacggcctggagacccacatggagacccacagcgacaaccccctgagatgcgacatctgctgcgtgaccttcagaacccacagaggcctgctgagacacaacgccctggtgcacaagcagctgcccagagacgccatgggcagacccttcatccagaacaaccccagcatccccgccggcttccacgacctgggcttcaccgacttcagctgcagaaagttccccagaatcagccaggcctggtgcgagaccaacctgagaagatgcatcagcgagcagcacagattcgtgtgcgacacctgcgacaaggccttccccatgctgtgcagcctggccctgcacaagcagacccacgtggccgccgaccagggccaggagaagccccaggccacccccctgcccggcgacgccctggaccagaagggcttcctggccctgctgggcctgcagcacaccaaggacgtgagacccgcccccgccgaggagcccctgcccgacgacaaccaggccatccagctgcagaccctgaagtgccagctgccccaggaccccggctgcaccaacctgctgagcctgagccccttcgaggccgccagcctgggcggcagcctgaccgtgctgcccgccaccaaggacagcatcaagcacctgagcctgcagcccttccagaagggcttcatcatccagcccgacagcagcatcgtggtgaagcccatcagcggcgagagcgccatcgagctggccgacatccagcagatcctgaagatggccgccagcgcccccccccagatcagcctgccccccttcagcaaggcccccgccgcccccctgcaggccatcttcaagcacatgccccccctgaagcccaagcccctggtgacccccagaaccgtggtggccaccagcacccccccccccctgatcaacgcccagcaggccagccccggctgcatcagccccagcctgccccccccccccctgaagctgctgaagggcagcgtggaggccgccagcaacgcccacctgctgcagagcaagagcggcacccagccccacgccgccaccagactgagcctgcagcagcccagagccgagctgcccggccagcccgagatgaagacccagctggagcaggacagcatcatcgaggccctgctgcccctgagcatggaggccaagatcaagcaggagatcaccgagggcgagctgaaggccttcatgaccgcccccggcggcaagaagacccccgccatgagaaaggtgctgtacccctgcagattctgcaaccaggtgttcgccttcagcggcgtgctgagagcccacgtgagaagccacctgggcatcagcccctaccagtgcaacatctgcgactacatcgccgccgacaaggccgccctgatcagacacctgagaacccacagcggcgagagaccctacatctgcaagatctgccactaccccttcaccgtgaaggccaactgcgagagacacctgagaaagaagcacctgaaggccaccagaaaggacatcgagaagaacatcgagtacgtgagcagcagcgccgccgagctggtggacgccttctgcgcccccgacaccgtgtgcagactgtgcggcgaggacctgaagcactacagagccctgagaatccacatgagaacccactgcggcagaggcctgggcggcggccacaagggcagaaagcccttcgagtgcaaggagtgcagcgccgccttcgccgccaagagaaactgcatccaccacatcctgaagcagcacctgcacgtgcccgagcaggacatcgagagctacgtgctggccgccgacggcctgggccccgccgaggcccccgccgccgaggccagcggcagaggcgaggacagcggctgcgccgccctgggcgactgcaagcccctgaccgccttcctggagccccagaacggcttcctgcacagaggccccacccagcccccccccccccacgtgagcatcaagctggagcccgccagcagcttcgccgtggacttcaacgagcccctggacttcagccagaagggcctggccctggtgcaggtgaagcaggagaacatcagcttcctgagccccagcagcctggtgccctacgactgcagcatggagcccatcgacctgagcatccccaagaacttcagaaagggcgacaaggacctggccacccccagcgaggccaagaagcccgaggaggaggccggcagcagcgagcagcccagcccctgccccgcccccggccccagcctgcccgtgaccctgggccccagcggcatcctggagagccccatggcccccgcccccgccgccacccccgagccccccgcccagcccctgcagggccccgtgcagctggccgtgcccatctacagcagcgccctggtgagcagcccccccctggtgggcagcagcgccctgctgagcggcaccgccctgctgagacccctgagacccaagccccccctgctgctgcccaagccccccgtgaccgaggagctgccccccctggccagcatcgcccagatcatcagcagcgtgagcagcgcccccaccctgctgaagaccaaggtggccgaccccggccccgccagcaccggcagcaacaccaccgccagcgacagcctgggcggcagcgtgcccaaggccgccaccaccgccacccccgccgccaccaccagccccaaggagagcagcgagccccccgcccccgccagcagccccgaggccgccagccccaccgagcagggccccgccggcaccagcaagaagagaggcagaaagagaggcatgagaagcagacccagagccaacagcggcggcgtggacctggacagcagcggcgagttcgccagcatcgagaagatgctggccaccaccgacaccaacaagttcagccccttcctgcagaccgccgaggacaacacccaggacgaggtggccggcgcccccgccgaccaccacggccccagcgacgaggagcagggcagcccccccgaggacaagctgctgagagccaagagaaacagctacaccaactgcctgcagaagatcacctgcccccactgccccagagtgttcccctgggccagcagcctgcagagacacatgctgacccacaccggccagaagcccttcccctgccagaagtgcgacgccttcttcagcaccaagagcaactgcgagagacaccagctgagaaagcacggcgtgaccacctgcagcctgagaagaaacggcctgatcccccagagcaaggagagcgacgtgggcagccacgacagcaccggcgagagaccctacaagtgccagacctgcgagagaaccttcaccctgaagcacagcctggtgagacaccagagaatccaccagaaggccagacacgccaagcaccacggcaaggacagcgacaaggaggagagaggcgaggaggacagcgagaacgagagcacccacagcggcaacaacgccgtgagcgagaacgaggccgagctggcccccaacgccagcaaccacatggccgtgaccagaagcagaaaggagggcctggccagcgccaccaaggactgcagccacagagaggagaaggtgaccgccggctggcccagcgagcccggccagggcgacctgaaccccgagagccccgccgccctgggccaggacctgctggagcccagaagcaagagacccgcccaccccatcctggccaccgccgacggcgccagccagctggtgggcatggagtag

SEQ ID NO: 96437 - DNA, 5064 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccaccaacggcaacatgcacagacacatgaagatccacgagaaggaccccaacagcgccaccgccaccgccccccccagccccctgaagagaagaagactgagcagcaagagaaagctgagccacgacgccgagagcgagagagaggaccccgcccccgccaagaagatggtggaggacggccagagcggcgacctggagaagaaggccgacgaggtgttccactgccccgtgtgcttcaaggagttcgtgtgcaagtacggcctggagacccacatggagacccacagcgacaaccccctgagatgcgacatctgctgcgtgaccttcagaacccacagaggcctgctgagacacaacgccctggtgcacaagcagctgcccagagacgccatgggcagacccttcatccagaacaaccccagcatccccgccggcttccacgacctgggcttcaccgacttcagctgcagaaagttccccagaatcagccaggcctggtgcgagaccaacctgagaagatgcatcagcgagcagcacagattcgtgtgcgacacctgcgacaaggccttccccatgctgtgcagcctggccctgcacaagcagacccacgtggccgccgaccagggccaggagaagccccaggccacccccctgcccggcgacgccctggaccagaagggcttcctggccctgctgggcctgcagcacaccaaggacgtgagacccgcccccgccgaggagcccctgcccgacgacaaccaggccatccagctgcagaccctgaagtgccagctgccccaggaccccggctgcaccaacctgctgagcctgagccccttcgaggccgccagcctgggcggcagcctgaccgtgctgcccgccaccaaggacagcatcaagcacctgagcctgcagcccttccagaagggcttcatcatccagcccgacagcagcatcgtggtgaagcccatcagcggcgagagcgccatcgagctggccgacatccagcagatcctgaagatggccgccagcgcccccccccagatcagcctgccccccttcagcaaggcccccgccgcccccctgcaggccatcttcaagcacatgccccccctgaagcccaagcccctggtgacccccagaaccgtggtggccaccagcacccccccccccctgatcaacgcccagcaggccagccccggctgcatcagccccagcctgccccccccccccctgaagctgctgaagggcagcgtggaggccgccagcaacgcccacctgctgcagagcaagagcggcacccagccccacgccgccaccagactgagcctgcagcagcccagagccgagctgcccggccagcccgagatgaagacccagctggagcaggacagcatcatcgaggccctgctgcccctgagcatggaggccaagatcaagcaggagatcaccgagggcgagctgaaggccttcatgaccgcccccggcggcaagaagacccccgccatgagaaaggtgctgtacccctgcagattctgcaaccaggtgttcgccttcagcggcgtgctgagagcccacgtgagaagccacctgggcatcagcccctaccagtgcaacatctgcgactacatcgccgccgacaaggccgccctgatcagacacctgagaacccacagcggcgagagaccctacatctgcaagatctgccactaccccttcaccgtgaaggccaactgcgagagacacctgagaaagaagcacctgaaggccaccagaaaggacatcgagaagaacatcgagtacgtgagcagcagcgccgccgagctggtggacgccttctgcgcccccgacaccgtgtgcagactgtgcggcgaggacctgaagcactacagagccctgagaatccacatgagaacccactgcggcagaggcctgggcggcggccacaagggcagaaagcccttcgagtgcaaggagtgcagcgccgccttcgccgccaagagaaactgcatccaccacatcctgaagcagcacctgcacgtgcccgagcaggacatcgagagctacgtgctggccgccgacggcctgggccccgccgaggcccccgccgccgaggccagcggcagaggcgaggacagcggctgcgccgccctgggcgactgcaagcccctgaccgccttcctggagccccagaacggcttcctgcacagaggccccacccagcccccccccccccacgtgagcatcaagctggagcccgccagcagcttcgccgtggacttcaacgagcccctggacttcagccagaagggcctggccctggtgcaggtgaagcaggagaacatcagcttcctgagccccagcagcctggtgccctacgactgcagcatggagcccatcgacctgagcatccccaagaacttcagaaagggcgacaaggacctggccacccccagcgaggccaagaagcccgaggaggaggccggcagcagcgagcagcccagcccctgccccgcccccggccccagcctgcccgtgaccctgggccccagcggcatcctggagagccccatggcccccgcccccgccgccacccccgagccccccgcccagcccctgcagggccccgtgcagctggccgtgcccatctacagcagcgccctggtgagcagcccccccctggtgggcagcagcgccctgctgagcggcaccgccctgctgagacccctgagacccaagccccccctgctgctgcccaagccccccgtgaccgaggagctgccccccctggccagcatcgcccagatcatcagcagcgtgagcagcgcccccaccctgctgaagaccaaggtggccgaccccggccccgccagcaccggcagcaacaccaccgccagcgacagcctgggcggcagcgtgcccaaggccgccaccaccgccacccccgccgccaccaccagccccaaggagagcagcgagccccccgcccccgccagcagccccgaggccgccagccccaccgagcagggccccgccggcaccagcaagaagagaggcagaaagagaggcatgagaagcagacccagagccaacagcggcggcgtggacctggacagcagcggcgagttcgccagcatcgagaagatgctggccaccaccgacaccaacaagttcagccccttcctgcagaccgccgaggacaacacccaggacgaggtggccggcgcccccgccgaccaccacggccccagcgacgaggagcagggcagcccccccgaggacaagctgctgagagccaagagaaacagctacaccaactgcctgcagaagatcacctgcccccactgccccagagtgttcccctgggccagcagcctgcagagacacatgctgacccacaccgacagccagagcgacgccgagaccgccgccgccgccggcgaggtgctggacctgaccagcagagacagagagcagcccagcgagggcgccaccgagctgagacaggtggccggcgacgcccccgtggagcaggccaccgccgagaccgccagccccgtgcacagagaggagcacggcagaggcgagagccacgagcccgaggaggagcacggcaccgaggagagcaccggcgacgccgacggcgccgaggaggacgccagcagcaaccagagcctggacctggacttcgccaccaagctgatggacttcaagctggccgagggcgacggcgaggccggcgccggcggcgccgccagccaggagcagaagctggcctgcgacacctgcggcaagagcttcaagttcctgggcaccctgagcagacacagaaaggcccacggcagacaggagcccaaggacgagaagggcgacggcgccagcaccgccgaggagggcccccagcccgcccccgagcaggaggagaagccccccgagacccccgccgaggtggtggagagcgcccccggcgccggcgaggcccccgccgagaagctggccgaggagaccgagggccccagcgacggcgagagcgccgccgagaagagaagcagcgagaagagcgacgacgacaagaagcccaagaccgacagccccaagagcgtggccagcaaggccgacaagagaaagaaggtgtgcagcgtgtgcaacaagagattctggagcctgcaggacctgaccagacacatgagaagccacaccggcgagagaccctacaagtgccagacctgcgagagaaccttcaccctgaagcacagcctggtgagacaccagagaatccaccagaaggccagacacgccaagcaccacggcaaggacagcgacaaggaggagagaggcgaggaggacagcgagaacgagagcacccacagcggcaacaacgccgtgagcgagaacgaggccgagctggcccccaacgccagcaaccacatggccgtgaccagaagcagaaaggagggcctggccagcgccaccaaggactgcagccacagagaggagaaggtgaccgccggctggcccagcgagcccggccagggcgacctgaaccccgagagccccgccgccctgggccaggacctgctggagcccagaagcaagagacccgcccaccccatcctggccaccgccgacggcgccagccagctggtgggcatggagtag

SEQ ID NO: 96438 - DNA, 5064 bp, Artificial Sequence; identical to SEQ ID NO: 96437
  Description of Artificial Sequence: Synthetic coding sequence

SEQ ID NO: 96439 - DNA, 5229 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccaccaacggcaacatgcacagacacatgaagatccacgagaaggaccccaacagcgccaccgccaccgccccccccagccccctgaagagaagaagactgagcagcaagagaaagctgagccacgacgccgagagcgagagagaggaccccgcccccgccaagaagatggtggaggacggccagagcggcgacctggagaagaaggccgacgaggtgttccactgccccgtgtgcttcaaggagttcgtgtgcaagtacggcctggagacccacatggagacccacagcgacaaccccctgagatgcgacatctgctgcgtgaccttcagaacccacagaggcctgctgagacacaacgccctggtgcacaagcagctgcccagagacgccatgggcagacccttcatccagaacaaccccagcatccccgccggcttccacgacctgggcttcaccgacttcagctgcagaaagttccccagaatcagccaggcctggtgcgagaccaacctgagaagatgcatcagcgagcagcacagattcgtgtgcgacacctgcgacaaggccttccccatgctgtgcagcctggccctgcacaagcagacccacgtggccgccgaccagggccaggagaagccccaggccacccccctgcccggcgacgccctggaccagaagggcttcctggccctgctgggcctgcagcacaccaaggacgtgagacccgcccccgccgaggagcccctgcccgacgacaaccaggccatccagctgcagaccctgaagtgccagctgccccaggaccccggctgcaccaacctgctgagcctgagccccttcgaggccgccagcctgggcggcagcctgaccgtgctgcccgccaccaaggacagcatcaagcacctgagcctgcagcccttccagaagggcttcatcatccagcccgacagcagcatcgtggtgaagcccatcagcggcgagagcgccatcgagctggccgacatccagcagatcctgaagatggccgccagcgcccccccccagatcagcctgccccccttcagcaaggcccccgccgcccccctgcaggccatcttcaagcacatgccccccctgaagcccaagcccctggtgacccccagaaccgtggtggccaccagcacccccccccccctgatcaacgcccagcaggccagccccggctgcatcagccccagcctgccccccccccccctgaagctgctgaagggcagcgtggaggccgccagcaacgcccacctgctgcagagcaagagcggcacccagccccacgccgccaccagactgagcctgcagcagcccagagccgagctgcccggccagcccgagatgaagacccagctggagcaggacagcatcatcgaggccctgctgcccctgagcatggaggccaagatcaagcaggagatcaccgagggcgagctgaaggccttcatgaccgcccccggcggcaagaagacccccgccatgagaaaggtgctgtacccctgcagattctgcaaccaggtgttcgccttcagcggcgtgctgagagcccacgtgagaagccacctgggcatcagcccctaccagtgcaacatctgcgactacatcgccgccgacaaggccgccctgatcagacacctgagaacccacagcggcgagagaccctacatctgcaagatctgccactaccccttcaccgtgaaggccaactgcgagagacacctgagaaagaagcacctgaaggccaccagaaaggacatcgagaagaacatcgagtacgtgagcagcagcgccgccgagctggtggacgccttctgcgcccccgacaccgtgtgcagactgtgcggcgaggacctgaagcactacagagccctgagaatccacatgagaacccactgcggcagaggcctgggcggcggccacaagggcagaaagcccttcgagtgcaaggagtgcagcgccgccttcgccgccaagagaaactgcatccaccacatcctgaagcagcacctgcacgtgcccgagcaggacatcgagagctacgtgctggccgccgacggcctgggccccgccgaggcccccgccgccgaggccagcggcagaggcgaggacagcggctgcgccgccctgggcgactgcaagcccctgaccgccttcctggagccccagaacggcttcctgcacagaggccccacccagcccccccccccccacgtgagcatcaagctggagcccgccagcagcttcgccgtggacttcaacgagcccctggacttcagccagaagggcctggccctggtgcaggtgaagcaggagaacatcagcttcctgagccccagcagcctggtgccctacgactgcagcatggagcccatcgacctgagcatccccaagaacttcagaaagggcgacaaggacctggccacccccagcgaggccaagaagcccgaggaggaggccggcagcagcgagcagcccagcccctgccccgcccccggccccagcctgcccgtgaccctgggccccagcggcatcctggagagccccatggcccccgcccccgccgccacccccgagccccccgcccagcccctgcagggccccgtgcagctggccgtgcccatctacagcagcgccctggtgagcagcccccccctggtgggcagcagcgccctgctgagcggcaccgccctgctgagacccctgagacccaagccccccctgctgctgcccaagccccccgtgaccgaggagctgccccccctggccagcatcgcccagatcatcagcagcgtgagcagcgcccccaccctgctgaagaccaaggtggccgaccccggccccgccagcaccggcagcaacaccaccgccagcgacagcctgggcggcagcgtgcccaaggccgccaccaccgccacccccgccgccaccaccagccccaaggagagcagcgagccccccgcccccgccagcagccccgaggccgccagccccaccgagcagggccccgccggcaccagcaagaagagaggcagaaagagaggcatgagaagcagacccagagccaacagcggcggcgtggacctggacagcagcggcgagttcgccagcatcgagaagatgctggccaccaccgacaccaacaagttcagccccttcctgcagaccgccgaggacaacacccaggacgaggtggccggcgcccccgccgaccaccacggccccagcgacgaggagcagggcagcccccccgaggacaagctgctgagagccaagagaaacagctacaccaactgcctgcagaagatcacctgcccccactgccccagagtgttcccctgggccagcagcctgcagagacacatgctgacccacaccggccagaagcccttcccctgccagaagtgcgacgccttcttcagcaccaagagcaactgcgagagacaccagctgagaaagcacggcgtgaccacctgcagcctgagaagaaacggcctgatcccccagagcaaggagagcgacgtgggcagccacgacagcaccgacagccagagcgacgccgagaccgccgccgccgccggcgaggtgctggacctgaccagcagagacagagagcagcccagcgagggcgccaccgagctgagacaggtggccggcgacgcccccgtggagcaggccaccgccgagaccgccagccccgtgcacagagaggagcacggcagaggcgagagccacgagcccgaggaggagcacggcaccgaggagagcaccggcgacgccgacggcgccgaggaggacgccagcagcaaccagagcctggacctggacttcgccaccaagctgatggacttcaagctggccgagggcgacggcgaggccggcgccggcggcgccgccagccaggagcagaagctggcctgcgacacctgcggcaagagcttcaagttcctgggcaccctgagcagacacagaaaggcccacggcagacaggagcccaaggacgagaagggcgacggcgccagcaccgccgaggagggcccccagcccgcccccgagcaggaggagaagccccccgagacccccgccgaggtggtggagagcgcccccggcgccggcgaggcccccgccgagaagctggccgaggagaccgagggccccagcgacggcgagagcgccgccgagaagagaagcagcgagaagagcgacgacgacaagaagcccaagaccgacagccccaagagcgtggccagcaaggccgacaagagaaagaaggtgtgcagcgtgtgcaacaagagattctggagcctgcaggacctgaccagacacatgagaagccacaccggcgagagaccctacaagtgccagacctgcgagagaaccttcaccctgaagcacagcctggtgagacaccagagaatccaccagaaggccagacacgccaagcaccacggcaaggacagcgacaaggaggagagaggcgaggaggacagcgagaacgagagcacccacagcggcaacaacgccgtgagcgagaacgaggccgagctggcccccaacgccagcaaccacatggccgtgaccagaagcagaaaggagggcctggccagcgccaccaaggactgcagccacagagaggagaaggtgaccgccggctggcccagcgagcccggccagggcgacctgaaccccgagagccccgccgccctgggccaggacctgctggagcccagaagcaagagacccgcccaccccatcctggccaccgccgacggcgccagccagctggtgggcatggagtag

SEQ ID NO: 96440 - DNA, 15 bp, Artificial Sequence
  Description of Artificial Sequence: Synthetic coding sequence
atgaccagcagctag

SEQ ID NO: 96441 - DNA, 495 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccaccaacggcaacatgcacagacacatgaagatccacgagaaggaccccaacagcgccaccgccaccgccccccccagccccctgaagtag

SEQ ID NO: 96442 - DNA, 2337 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccaccaacggcaacatgcacagacacatgaagatccacgagaaggaccccaacagcgccaccgccaccgccccccccagccccctgaagagaagaagactgagcagcaagagaaagctgagccacgacgccgagagcgagagagaggaccccgcccccgccaagaagatggtggaggacggccagagcggcgacctggagaagaaggccgacgaggtgttccactgccccgtgtgcttcaaggagttcgtgtgcaagtacggcctggagacccacatggagacccacagcgacaaccccctgagatgcgacatctgctgcgtgaccttcagaacccacagaggcctgctgagacacaacgccctggtgcacaagcagctgcccagagacgccatgggcagacccttcatccagaacaaccccagcatccccgccggcttccacgacctgggcttcaccgacttcagctgcagaaagttccccagaatcagccaggcctggtgcgagaccaacctgagaagatgcatcagcgagcagcacagattcgtgtgcgacacctgcgacaaggccttccccatgctgtgcagcctggccctgcacaagcagacccacgtggccgccgaccagggccaggagaagccccaggccacccccctgcccggcgacgccctggaccagaagggcttcctggccctgctgggcctgcagcacaccaaggacgtgagacccgcccccgccgaggagcccctgcccgacgacaaccaggccatccagctgcagaccctgaagtgccagctgccccaggaccccggctgcaccaacctgctgagcctgagccccttcgaggccgccagcctgggcggcagcctgaccgtgctgcccgccaccaaggacagcatcaagcacctgagcctgcagcccttccagaagggcttcatcatccagcccgacagcagcatcgtggtgaagcccatcagcggcgagagcgccatcgagctggccgacatccagcagatcctgaagatggccgccagcgcccccccccagatcagcctgccccccttcagcaaggcccccgccgcccccctgcaggccatcttcaagcacatgccccccctgaagcccaagcccctggtgacccccagaaccgtggtggccaccagcacccccccccccctgatcaacgcccagcaggccagccccggctgcatcagccccagcctgccccccccccccctgaagctgctgaagggcagcgtggaggccgccagcaacgcccacctgctgcagagcaagagcggcacccagccccacgccgccaccagactgagcctgcagcagcccagagccgagctgcccggccagcccgagatgaagacccagctggagcaggacagcatcatcgaggccctgctgcccctgagcatggaggccaagatcaagcaggagatcaccgagggcgagctgaaggccttcatgaccgcccccggcggcaagaagacccccgccatgagaaaggtgctgtacccctgcagattctgcaaccaggtgttcgccttcagcggcgtgctgagagcccacgtgagaagccacctgggcatcagcccctaccagtgcaacatctgcgactacatcgccgccgacaaggccgccctgatcagacacctgagaacccacagcggcgagagaccctacatctgcaagatctgccactaccccttcaccgtgaaggccaactgcgagagacacctgagaaagaagcacctgaaggccaccagaaaggacatcgagaagaacatcgagtacgtgagcagcagcgccgccgagctggtggacgccttctgcgcccccgacaccgtgtgcagactgtgcggcgaggacctgaagcactacagagccctgagaatccacatgagaacccactgcggcagatag

SEQ ID NO: 96443 - DNA, 411 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggagaccaaggaggagaagagcagctacaactgccccctgtgcgagaagatctgcaccacccagcaccagctgaccatgcacatcagacagcacaacaccgacaccggcggcgccgaccacagctgcagcatctgcggcaagagcctgagcagcgccagcagcctggacagacacatgctggtgcacagcggcgagagaccctacaagtgcaccgtgtgcggccagagcttcaccacctag

SEQ ID NO: 96444 - DNA, 189 bp, Artificial Sequence
  Description of Artificial Sequence: Synthetic coding sequence
atgaccagcagcagccccgccggcctggagggcagcgacctgagcagcatcaacaccatgatgagcgccgtgatgagcgtgggcaaggtgaccgagaacggcggcagcccccagggcatcaagagccccagcaagccccccggccccaacagaatcggcagaagaaaccaggtgagcgtgcacacctag

SEQ ID NO: 96445 - DNA, 834 bp, Artificial Sequence
  Description of Artificial Sequence: Synthetic coding sequence
atgagcaagagcctgaagaagctggtggaggagagcagagagaagaaccagcccgaggtggacatgagcgacagaggcatcagcaacatgctggacgtgaacggcctgttcaccctgagccacatcacccagctggtgctgagccacaacaagctgaccatggtgccccccaacatcgccgagctgaagaacctggaggtgctgaacttcttcaacaaccagatcgaggagctgcccacccagatcagcagcctgcagaagctgaagcacctgaacctgggcatgaacagactgaacaccctgcccagaggcttcggcagcctgcccgccctggaggtgctggacctgacctacaacaacctgagcgagaacagcctgcccggcaacttcttctacctgaccaccctgagagccctgtacctgagcgacaacgacttcgagatcctgccccccgacatcggcaagctgaccaagctgcagatcctgagcctgagagacaacgacctgatcagcctgcccaaggagatcggcgagctgacccagctgaaggagctgcacatccagggcaacagactgaccgtgctgccccccgagctgggcaacctggacctgaccggccagaagcaggtgttcaaggccgagaacaacccctgggtgacccccatcgccgaccagttccagctgggcgtgagccacgtgttcgagtacatcagaagcgagacctacaagtacctgtacggcagacacatgcaggccaaccccgagccccccaagaagaacaacgacaagagcaagaagatcagcagaaagcccctggccgccaagaacagatag

SEQ ID NO: 96446 - DNA, 675 bp, Artificial Sequence
  Description of Artificial Sequence: Synthetic coding sequence
atggtgccccccaacatcgccgagctgaagaacctggaggtgctgaacttcttcaacaaccagatcgaggagctgcccacccagatcagcagcctgcagaagctgaagcacctgaacctgggcatgaacagactgaacaccctgcccagaggcttcggcagcctgcccgccctggaggtgctggacctgacctacaacaacctgagcgagaacagcctgcccggcaacttcttctacctgaccaccctgagagccctgtacctgagcgacaacgacttcgagatcctgccccccgacatcggcaagctgaccaagctgcagatcctgagcctgagagacaacgacctgatcagcctgcccaaggagatcggcgagctgacccagctgaaggagctgcacatccagggcaacagactgaccgtgctgccccccgagctgggcaacctggacctgaccggccagaagcaggtgttcaaggccgagaacaacccctgggtgacccccatcgccgaccagttccagctgggcgtgagccacgtgttcgagtacatcagaagcgagacctacaagtacctgtacggcagacacatgcaggccaaccccgagccccccaagaagaacaacgacaagagcaagaagatcagcagaaagcccctggccgccaagaacagatag

SEQ ID NO: 96447 - DNA, 834 bp, Artificial Sequence; identical to SEQ ID NO: 96445
  Description of Artificial Sequence: Synthetic coding sequence

SEQ ID NO: 96448 - DNA, 945 bp, Artificial Sequence
  Description of Artificial Sequence: Synthetic coding sequence
atggccgccaccgccagcgccggcgccggcggcatcgacggcaagcccagaaccagccccaagagcgtgaagttcctgttcggcggcctggccggcatgggcgccaccgtgttcgtgcagcccctggacctggtgaagaacagaatgcagctgagcggcgagggcgccaagaccagagagtacaagaccagcttccacgccctgaccagcatcctgaaggccgagggcctgagaggcatctacaccggcctgagcgccggcctgctgagacaggccacctacaccaccaccagactgggcatctacaccgtgctgttcgagagactgaccggcgccgacggcaccccccccggcttcctgctgaaggccgtgatcggcatgaccgccggcgccaccggcgccttcgtgggcacccccgccgaggtggccctgatcagaatgaccgccgacggcagactgcccgccgaccagagaagaggctacaagaacgtgttcaacgccctgatcagaatcaccagagaggagggcgtgctgaccctgtggagaggctgcatccccaccatggccagagccgtggtggtgaacgccgcccagctggccagctacagccagagcaagcagttcctgctggacagcggctacttcagcgacaacatcctgtgccacttctgcgccagcatgatcagcggcctggtgaccaccgccgccagcatgcccgtggacatcgccaagaccagaatccagaacatgagaatgatcgacggcaagcccgagtacaagaacggcctggacgtgctgttcaaggtggtgagatacgagggcttcttcagcctgtggaagggcttcaccccctactacgccagactgggcccccacaccgtgctgaccttcatcttcctggagcagatgaacaaggcctacaagagactgttcctgagcggctag

SEQ ID NO: 96449 - DNA, 1530 bp, Artificial Sequence; identical to SEQ ID NO: 73304
  Description of Artificial Sequence: Synthetic coding sequence

SEQ ID NO: 96450 - DNA, 600 bp, Artificial Sequence
  Description of Artificial Sequence: Synthetic coding sequence
atggccaagagcgccgaggtgaagctggccatcttcggcagagccggcgtgggcaagagcgccctggtggtgagattcctgaccaagagattcatctgggagtacgaccccaccctggagagcacctacagacaccaggccaccatcgacgacgaggtggtgagcatggagatcctggacaccgccggccaggaggacaccatccagagagagggccacatgagatggggcgagggcttcgtgctggtgtacgacatcaccgacagaggcagcttcgaggaggtgctgcccctgaagaacatcctggacgagatcaagaagcccaagaacgtgaccctgatcctggtgggcaacaaggccgacctggaccacagcagacaggtgagcaccgaggagggcgagaagctggccaccgagctggcctgcgccttctacgagtgcagcgcctgcaccggcgagggcaacatcaccgagatcttctacgagctgtgcagagaggtgagaagaagaagaatggtgcagggcaagaccagaagaagaagcagcaccacccacgtgaagcaggccatcaacaagatgctgaccaagatcagcagctag

SEQ ID NO: 96451 - DNA, 120 bp, Artificial Sequence
  Description of Artificial Sequence: Synthetic coding sequence
atggccaagagcgccgaggtgaagctggccatcttcggcagagccggcgtgggcaagagcgccctggtggtgagattcctgaccaagagattcatctgggagtacgaccccaccctgtag

SEQ ID NO: 96452 - DNA, 600 bp, Artificial Sequence; identical to SEQ ID NO: 96450
  Description of Artificial Sequence: Synthetic coding sequence

SEQ ID NO: 96453 - DNA, 600 bp, Artificial Sequence; identical to SEQ ID NO: 96450
  Description of Artificial Sequence: Synthetic coding sequence

SEQ ID NO: 96454 - DNA, 543 bp, Artificial Sequence
  Description of Artificial Sequence: Synthetic coding sequence
atggccaagagcgccgaggtgaagctggccatcttcggcagagccggcgtgggcaagagcgagagcacctacagacaccaggccaccatcgacgacgaggtggtgagcatggagatcctggacaccgccggccaggaggacaccatccagagagagggccacatgagatggggcgagggcttcgtgctggtgtacgacatcaccgacagaggcagcttcgaggaggtgctgcccctgaagaacatcctggacgagatcaagaagcccaagaacgtgaccctgatcctggtgggcaacaaggccgacctggaccacagcagacaggtgagcaccgaggagggcgagaagctggccaccgagctggcctgcgccttctacgagtgcagcgcctgcaccggcgagggcaacatcaccgagatcttctacgagctgtgcagagaggtgagaagaagaagaatggtgcagggcaagaccagaagaagaagcagcaccacccacgtgaagcaggccatcaacaagatgctgaccaagatcagcagctag

SEQ ID NO: 96455 - DNA, 612 bp, Artificial Sequence
  Description of Artificial Sequence: Synthetic coding sequence
atggtgagcacctacagagtggccgtgctgggcgccagaggcgtgggcaagagcgccatcgtgagacagttcctgtacaacgagttcagcgaggtgtgcgtgcccaccaccgccagaagactgtacctgcccgccgtggtgatgaacggccacgtgcacgacctgcagatcctggacttcccccccatcagcgccttccccgtgaacaccctgcaggagtgggccgacacctgctgcagaggcctgagaagcgtgcacgcctacatcctggtgtacgacatctgctgcttcgacagcttcgagtacgtgaagaccatcagacagcagatcctggagaccagagtgatcggcaccagcgagacccccatcatcatcgtgggcaacaagagagacctgcagagaggcagagtgatccccagatggaacgtgagccacctggtgagaaagacctggaagtgcggctacgtggagtgcagcgccaagtacaactggcacatcctgctgctgttcagcgagctgctgaagagcgtgggctgcgccagatgcaagcacgtgcacgccgccctgagattccagggcgccctgagaagaaacagatgcgccatcatgtag

SEQ ID NO: 96456 - DNA, 729 bp, Artificial Sequence
  Description of Artificial Sequence: Synthetic coding sequence
atgagacccctgagcatgagcggccacttcctgctggcccccatccccgagagcagcagcgactacctgctgcccaaggacatcaagctggccgtgctgggcgccggcagagtgggcaagagcgccatgatcgtgagattcctgaccaagagattcatcggcgactacgagcccaacaccggcaagctgtacagcagactggtgtacgtggagggcgaccagctgagcctgcagatccaggacacccccggcggcgtgcagatccaggacagcctgccccaggtggtggacagcctgagcaagtgcgtgcagtgggccgagggcttcctgctggtgtacagcatcaccgactacgacagctacctgagcatcagacccctgtaccagcacatcagaaaggtgcaccccgacagcaaggcccccgtgatcatcgtgggcaacaagggcgacctgctgcacgccagacaggtgcagacccaggacggcatccagctggccaacgagctgggcagcctgttcctggagatcagcaccagcgagaactacgaggacgtgtgcgacgtgttccagcacctgtgcaaggaggtgagcaagatgcacggcctgagcggcgagagaagaagagccagcatcatccccagacccagaagccccaacatgcaggacctgaagagaagattcaagcaggccctgagccccaaggtgaaggcccccagcgccctgggctag

SEQ ID NO: 96457 - DNA, 747 bp, Artificial Sequence
  Description of Artificial Sequence: Synthetic coding sequence
atgagactgatccagaacatgtgcaccatcgccgagtaccccgcccccggcaacgccgccgccagcgactgctgcgtgggcgccgccggcagaagactggtgaagatcgccgtggtgggcgccagcggcgtgggcaagaccgccctggtggtgagattcctgaccaagagattcatcggcgactacgagagaaacgccggcaacctgtacaccagacaggtgcagatcgagggcgagaccctggccctgcaggtgcaggacacccccggcatccaggtgcacgagaacagcctgagctgcagcgagcagctgaacagatgcatcagatgggccgacgccgtggtgatcgtgttcagcatcaccgactacaagagctacgagctgatcagccagctgcaccagcacgtgcagcagctgcacctgggcaccagactgcccgtggtggtggtggccaacaaggccgacctgctgcacatcaagcaggtggacccccagctgggcctgcagctggccagcatgctgggctgcagcttctacgaggtgagcgtgagcgagaactacaacgacgtgtacagcgccttccacgtgctgtgcaaggaggtgagccacaagcagcagcccagcagcacccccgagaagagaagaaccagcctgatccccagacccaagagccccaacatgcaggacctgaagagaagattcaagcaggccctgagcgccaaggtgagaaccgtgaccagcgtgtag

SEQ ID NO: 96458 - DNA, 927 bp, Artificial Sequence
  Description of Artificial Sequence: Synthetic coding sequence
atgaccctgaacggcggcggcagcggcgccggcggcagcagaggcggcggccaggagagagagagaagaagaggcagcaccccctggggccccgccccccccctgcacagaagaagcatgcccgtggacgagagagacctgcaggccgccctgacccccggcgccctgaccgccgccgccgccggcaccggcacccagggccccagactggactggcccgaggacagcgaggacagcctgagcagcggcggcagcgacagcgacgagagcgtgtacaaggtgctgctgctgggcgcccccggcgtgggcaagagcgccctggccagaatcttcggcggcgtggaggacggccccgaggccgaggccgccggccacacctacgacagaagcatcgtggtggacggcgaggaggccagcctgatggtgtacgacatctgggagcaggacggcggcagatggctgcccggccactgcatggccatgggcgacgcctacgtgatcgtgtacagcgtgaccgacaagggcagcttcgagaaggccagcgagctgagagtgcagctgagaagagccagacagaccgacgacgtgcccatcatcctggtgggcaacaagagcgacctggtgagaagcagagaggtgagcgtggacgagggcagagcctgcgccgtggtgttcgactgcaagttcatcgagaccagcgccgccctgcaccacaacgtgcaggccctgttcgagggcgtggtgagacagatcagactgagaagagacagcaaggaggccaacgccagaagacaggccggcaccagaagaagagagagcctgggcaagaaggccaagagattcctgggcagaatcgtggccagaaacagcagaaagatggccttcagagccaagagcaagagctgccacgacctgagcgtgctgtag

SEQ ID NO: 96459 - DNA, 927 bp, Artificial Sequence; identical to SEQ ID NO: 96458
  Description of Artificial Sequence: Synthetic coding sequence

SEQ ID NO: 96460 - DNA, 579 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgttcgacaactacagcgccaacgtgatggtggacggcaagcccgtgaacctgggcctgtgggacaccgccggccaggaggactacgacagactgagacccctgagctacccccagaccgacgtgttcctgatctgcttcagcctggtgagccccgccagcttcgagaacgtgagagccaagtggtaccccgaggtgagacaccactgcccccacacccccatcctgctggtgggcaccaagctggacctgagagacgacaaggacaccatcgagagactgagagacaagaagctggcccccatcacctacccccagggcctggccatggccagagagatcggcagcgtgaagtacctggagtgcagcgccctgacccagagaggcctgaagaccgtgttcgacgaggccatcagagccgtgctgtgccccccccccgtgaagaagcccggcaagaagtgcaccgtgttctag

SEQ ID NO: 96461 - DNA, 942 bp, Artificial Sequence
  Description of Artificial Sequence: Synthetic coding sequence
atgcccaacaccgccatgaagaagaaggtgctgctgatgggcaagagcggcagcggcaagaccagcatgagaagcatcatcttcgccaactacatcgccagagacaccagaagactgggcgccaccatcgacgtggagcacagccacgtgagattcctgggcaacctggtgctgaacctgtgggactgcggcggccaggacaccttcatggagaactacttcaccagccagagagacaacatcttcagaaacgtggaggtgctgatctacgtgttcgacgtggagagcagagagctggagaaggacatgcactactaccagagctgcctggaggccatcctgcagaacagccccgacgccaagatcttctgcctggtgcacaagatggacctggtgcaggaggaccagagagacctgatcttcaaggagagagaggaggacctgagaagactgagcagacccctggagtgcgcctgcttcagaaccagcatctgggacgagaccctgtacaaggcctggagcagcatcgtgtaccagctgatccccaacgtgcagcagctggagatgaacctgagaaacttcgcccagatcatcgaggccgacgaggtgctgctgttcgagagagccaccttcctggtgatcagccactaccagtgcaaggagcagagagacgtgcacagattcgagaagatcagcaacatcatcaagcagttcaagctgagctgcagcaagctggccgccagcttccagagcatggaggtgagaaacagcaacttcgccgccttcatcgacatcttcaccagcaacacctacgtgatggtggtgatgagcgaccccagcatccccagcgccgccaccctgatcaacatcagaaacgccagaaagcacttcgagaagctggagagagtggacggccccaagcacagcctgctgatgagatag

SEQ ID NO: 96462 - DNA, 1125 bp, Artificial Sequence
  Description of Artificial Sequence: Synthetic coding sequence
atggaggagagcgacagcgagaagaccaccgagaaggagaacctgggccccagaatggacccccccctgggcgagcccgagggcagcctgggctgggtgctgcccaacaccgccatgaagaagaaggtgctgctgatgggcaagagcggcagcggcaagaccagcatgagaagcatcatcttcgccaactacatcgccagagacaccagaagactgggcgccaccatcctggacagaatccacagcctgcagatcaacagcagcctgagcacctacagcctggtggacagcgtgggcaacaccaagaccttcgacgtggagcacagccacgtgagattcctgggcaacctggtgctgaacctgtgggactgcggcggccaggacaccttcatggagaactacttcaccagccagagagacaacatcttcagaaacgtggaggtgctgatctacgtgttcgacgtggagagcagagagctggagaaggacatgcactactaccagagctgcctggaggccatcctgcagaacagccccgacgccaagatcttctgcctggtgcacaagatggacctggtgcaggaggaccagagagacctgatcttcaaggagagagaggaggacctgagaagactgagcagacccctggagtgcagctgcttcagaaccagcatctgggacgagaccctgtacaaggcctggagcagcatcgtgtaccagctgatccccaacgtgcagcagctggagatgaacctgagaaacttcgccgagatcatcgaggccgacgaggtgctgctgttcgagagagccaccttcctggtgatcagccactaccagtgcaaggagcagagagacgcccacagattcgagaagatcagcaacatcatcaagcagttcaagctgagctgcagcaagctggccgccagcttccagagcatggaggtgagaaacagcaacttcgccgccttcatcgacatcttcaccagcaacacctacgtgatggtggtgatgagcgaccccagcatccccagcgccgccaccctgatcaacatcagaaacgccagaaagcacttcgagaagctggagagagtggacggccccaagcagtgcctgctgatgagatag

SEQ ID NO: 96463 - DNA, 1041 bp, Artificial Sequence
  Description of Artificial Sequence: Synthetic coding sequence
atggaggagagcgacagcgagaagaccaccgagaaggagaacctgggccccagaatggacccccccctgggcgagcccgagggcagcctgggctgggtgctgcccaacaccgccatgaagaagaaggtgctgctgatgggcaagagcggcagcggcaagaccagcatgagaagcatcatcttcgccaactacatcgccagagacaccagaagactgggcgccaccatcgacgtggagcacagccacgtgagattcctgggcaacctggtgctgaacctgtgggactgcggcggccaggacaccttcatggagaactacttcaccagccagagagacaacatcttcagaaacgtggaggtgctgatctacgtgttcgacgtggagagcagagagctggagaaggacatgcactactaccagagctgcctggaggccatcctgcagaacagccccgacgccaagatcttctgcctggtgcacaagatggacctggtgcaggaggaccagagagacctgatcttcaaggagagagaggaggacctgagaagactgagcagacccctggagtgcagctgcttcagaaccagcatctgggacgagaccctgtacaaggcctggagcagcatcgtgtaccagctgatccccaacgtgcagcagctggagatgaacctgagaaacttcgccgagatcatcgaggccgacgaggtgctgctgttcgagagagccaccttcctggtgatcagccactaccagtgcaaggagcagagagacgcccacagattcgagaagatcagcaacatcatcaagcagttcaagctgagctgcagcaagctggccgccagcttccagagcatggaggtgagaaacagcaacttcgccgccttcatcgacatcttcaccagcaacacctacgtgatggtggtgatgagcgaccccagcatccccagcgccgccaccctgatcaacatcagaaacgccagaaagcacttcgagaagctggagagagtggacggccccaagcagtgcctgctgatgagatag

SEQ ID NO: 96464 - DNA, 585 bp, Artificial Sequence
  Description of Artificial Sequence: Synthetic coding sequence
atgaagaagaaggtgctgctgatgggcaagagcggcagcggcaagaccagcatgagaagcatcatcttcgccaactacatcgccagagacaccagaagactgggcgccaccatcgacgtggagcacagccacgtgagattcctgggcaacctggtgctgaacctgtgggactgcggcggccaggacaccttcatggagaactacttcaccagccagagagacaacatcttcagaaacgtggaggtgctgatctacgtgttcgacgtggagagcagagagctggagaaggacatgcactactaccagagctgcctggaggccatcctgcagaacagccccgacgccaagatcttctgcctggtgcacaagatggacctggtgcaggaggaccagagagacctgatcttcaaggagagagaggaggacctgagaagactgagcagacccctggagtgcagctgcttcagaaccagcatctgggacgagaccctgtacaaggcctggagcagcatcgtgtaccagctgatccccaacgtgcagcagctggagatgaacctgagaaacttcgccgagatcatcgagtag

SEQ ID NO: 96465 - DNA, 1200 bp, Artificial Sequence
  Description of Artificial Sequence: Synthetic coding sequence
atgagcctgcagtacggcgccgaggagacccccctggccggcagctacggcgccgccgacagcttccccaaggacttcggctacggcgtggaggaggaggaggaggaggccgccgccgccggcggcggcgtgggcgccggcgccggcggcggctgcggccccggcggcgccgacagcagcaagcccagaatcctgctgatgggcctgagaagaagcggcaagagcagcatccagaaggtggtgttccacaagatgagccccaacgagaccctgttcctggagagcaccaacaagatctacaaggacgacatcagcaacagcagcttcgtgaacttccagatctgggacttccccggccagatggacttcttcgaccccaccttcgactacgagatgatcttcagaggcaccggcgccctgatctacgtgatcgacgcccaggacgactacatggaggccctgaccagactgcacatcaccgtgagcaaggcctacaaggtgaaccccgacatgaacttcgaggtgttcatccacaaggtggacggcctgagcgacgaccacaagatcgagacccagagagacatccaccagagagccaacgacgacctggccgacgccggcctggagaagctgcacctgagcttctacctgaccagcatctacgaccacagcatcttcgaggccttcagcaaggtggtgcagaagctgatcccccagctgcccaccctggagaacctgctgaacatcttcatcagcaacagcggcatcgagaaggccttcctgttcgacgtggtgagcaagatctacatcgccaccgacagcagccccgtggacatgcagagctacgagctgtgctgcgacatgatcgacgtggtgatcgacgtgagctgcatctacggcctgaaggaggacggcagcggcagcgcctacgacaaggagagcatggccatcatcaagctgaacaacaccaccgtgctgtacctgaaggaggtgaccaagttcctggccctggtgtgcatcctgagagaggagagcttcgagagaaagggcctgatcgactacaacttccactgcttcagaaaggccatccacgaggtgttcgaggtgggcgtgaccagccacagaagctgcggccaccagaccagcgccagcagcctgaaggccctgacccacaacggcacccccagaaacgccatctag

SEQ ID NO: 96466 - DNA, 750 bp, Artificial Sequence
  Description of Artificial Sequence: Synthetic coding sequence
atggaggccctggccagactgcacctgaccgtgaccagagcctacaaggtgaacaccgacatcaacttcgaggtgttcatccacaaggtggacggcctgagcgacgaccacaagatcgagacccagagagacatccaccagagagccaacgacgacctggccgacgccggcctggagaagatccacctgagcttctacctgaccagcatctacgaccacagcatcttcgaggccttcagcaaggtggtgcagaagctgatcccccagctgcccaccctggagaacctgctgaacatcttcatcagcaacagcggcatcgagaaggccttcctgttcgacgtggtgagcaagatctacatcgccaccgacagcacccccgtggacatgcagacctacgagctgtgctgcgacatgatcgacgtggtgatcgacatcagctgcatctacggcctgaaggaggacggcgccggcaccccctacgacaaggagagcaccgccatcatcaagctgaacaacaccaccgtgctgtacctgaaggaggtgaccaagttcctggccctggtgtgcttcgtgagagaggagagcttcgagagaaagggcctgatcgactacaacttccactgcttcagaaaggccatccacgaggtgttcgaggtgagaatgaaggtggtgaagagcagaaaggtgcagaacagactgcagaagaagaagagagccacccccaacggcacccccagagtgctgctgtag

SEQ ID NO: 96467 - DNA, 1203 bp, Artificial Sequence
  Description of Artificial Sequence: Synthetic coding sequence
atgagccaggtgctgggcaagccccagccccaggacgaggacgacgccgaggaggaggaggaggaggacgagctggtgggcctggccgactacggcgacggccccgacagcagcgacgccgaccccgacagcggcaccgaggagggcgtgctggacttcagcgaccccttcagcaccgaggtgaagcccagaatcctgctgatgggcctgagaagaagcggcaagagcagcatccagaaggtggtgttccacaagatgagccccaacgagaccctgttcctggagagcaccaacaagatctgcagagaggacgtgagcaacagcagcttcgtgaacttccagatctgggacttccccggccagatcgacttcttcgaccccaccttcgactacgagatgatcttcagaggcaccggcgccctgatcttcgtgatcgacagccaggacgactacatggaggccctggccagactgcacctgaccgtgaccagagcctacaaggtgaacaccgacatcaacttcgaggtgttcatccacaaggtggacggcctgagcgacgaccacaagatcgagacccagagagacatccaccagagagccaacgacgacctggccgacgccggcctggagaagatccacctgagcttctacctgaccagcatctacgaccacagcatcttcgaggccttcagcaaggtggtgcagaagctgatcccccagctgcccaccctggagaacctgctgaacatcttcatcagcaacagcggcatcgagaaggccttcctgttcgacgtggtgagcaagatctacatcgccaccgacagcacccccgtggacatgcagacctacgagctgtgctgcgacatgatcgacgtggtgatcgacatcagctgcatctacggcctgaaggaggacggcgccggcaccccctacgacaaggagagcaccgccatcatcaagctgaacaacaccaccgtgctgtacctgaaggaggtgaccaagttcctggccctggtgtgcttcgtgagagaggagagcttcgagagaaagggcctgatcgactacaacttccactgcttcagaaaggccatccacgaggtgttcgaggtgagaatgaaggtggtgaagagcagaaaggtgcagaacagactgcagaagaagaagagagccacccccaacggcacccccagagtgctgctgtag

SEQ ID NO: 96468 - DNA, 348 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaaggagagaaacatgaacttcaccagagagcagagcagacaccccgcctggtggttcatgagcgtgaaggtgaagctgaagagaaagaagagacagaagacccccaacagaaagctgcccagaagaggcgcccccaccctgagaccccagagatag

SEQ ID NO: 96469 - DNA, 726 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaaggagagattcgaggccctgttcaccatctacgacgaccaggtgaccttccagctgttcaagagcttcagaagagtgagaatcaacttcagcaagcccgaggccgccgccagagccagaatcgagctgcacgagaccgacttcaacggccagaagctgaagctgtacttcgcccaggtgcagatgagcggcgaggtgagagacaagagctacctgctgcccccccagcccgtgaagcagttcctgatcagcccccccgccagcccccccgtgggctggaagcagagcgaggacgccatgcccgtgatcaactacgacctgctgtgcgccgtgagcaagctgggccccggcgagaagtacgagctgcacgccggcaccgagagcacccccagcgtggtggtgcacgtgtgcgagagcgagaccgaggaggaggaggagaccaagaaccccaagcagaagatcgcccagaccagaagacccgacccccccaccgccgccctgaacgagccccagaccttcgactgcgccctgtag

SEQ ID NO: 96470 - DNA, 522 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaaggagagattcgaggccctgttcaccatctacgacgaccaggtgaccttccagctgttcaagagcttcagaagagtgagaatcaacttcagcaagcccgaggccgccgccagagccagaatcgagctgcacgagaccgacttcaacggccagaagctgaagctgtacttcgcccaggagagaaacatgaacttcaccagagagcagagcagacaccccgcctggtggttcatgagcgtgaaggtgaagctgaagagaaagaagagacagaagacccccaacagaaagctgcccagaagaggcgcccccaccctgagaccccagagatag

SEQ ID NO: 96471 - DNA, 198 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaagtag

SEQ ID NO: 96472 - DNA, 696 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaaggagagattcgaggccctgttcaccatctacgacgaccaggtgaccttccagctgttcaagagcttcagaagagtgagaatcaacttcagcaagcccgaggccgccgccagagccagaatcgagctgcacgagaccgacttcaacggccagaagctgaagctgtacttcgcccagagctacctgctgcccccccagcccgtgaagcagttcctgatcagcccccccgccagcccccccgtgggctggaagcagagcgaggacgccatgcccgtgatcaactacgacctgctgtgcgccgtgagcaagctgggccccggcgagaagtacgagctgcacgccggcaccgagagcacccccagcgtggtggtgcacgtgtgcgagagcgagaccgaggaggaggaggagaccaagaaccccaagcagaagatcgcccagaccagaagacccgacccccccaccgccgccctgaacgagccccagaccttcgactgcgccctgtag

SEQ ID NO: 96473 - DNA, 552 bp, Artificial Sequence
  Description of Artificial Sequence: Synthetic coding sequence
atgctgagagacaccatgaagagctggaacgacagccagagcgacctgtgcagcaccgaccaggaggaggaggaggagatgatcttcggcgagaacgaggacgacctggacgagatgatggacctgagcgacctgcccaccagcctgttcgcctgcagcgtgcacgaggccgtgttcgaggccagagagcagaaggtgcagatgagcggcgaggtgagagacaagagctacctgctgcccccccagcccgtgaagcagttcctgatcagcccccccgccagcccccccgtgggctggaagcagagcgaggacgccatgcccgtgatcaactacgacctgctgtgcgccgtgagcaagctgggccccggcgagaagtacgagctgcacgccggcaccgagagcacccccagcgtggtggtgcacgtgtgcgagagcgagaccgaggaggaggaggagaccaagaaccccaagcagaagatcgcccagaccagaagacccgacccccccaccgccgccctgaacgagccccagaccttcgactgcgccctgtag

SEQ ID NO: 96474 - DNA, 900 bp, Artificial Sequence
  Description of Artificial Sequence: Synthetic coding sequence
atgcacagcctggccaccgccgcccccgtgcccaccaccctggcccaggtggacagagagaagatctaccagtggatcaacgagctgagcagccccgagaccagagagaacgccctgctggagctgagcaagaagagagagagcgtgcccgacctggcccccatgctgtggcacagcttcggcaccatcgccgccctgctgcaggagatcgtgaacatctaccccagcatcaacccccccaccctgaccgcccaccagagcaacagagtgtgcaacgccctggccctgctgcagtgcgtggccagccaccccgagaccagaagcgccttcctggccgcccacatccccctgttcctgtaccccttcctgcacaccgtgagcaagaccagacccttcgagtacctgagactgaccagcctgggcgtgatcggcgccctggtgaagaccgacgagcaggaggtgatcaacttcctgctgaccaccgagatcatccccctgtgcctgagaatcatggagagcggcagcgagctgagcaagaccgtggccaccttcatcctgcagaagatcctgctggacgacaccggcctggcctacatctgccagacctacgagagattcagccacgtggccatgatcctgggcaagatggtgctgcagctgagcaaggagcccagcgccagactgctgaagcacgtggtgagatgctacctgagactgagcgacaaccccagagccagagaggccctgagacagtgcctgcccgaccagctgaaggacaccaccttcgcccaggtgctgaaggacgacaccaccaccaagagatggctggcccagctggtgaagaacctgcaggagggccaggtgaccgaccccagaggcatccccctgcccccccagtag

SEQ ID NO: 96475 - DNA, 996 bp, Artificial Sequence
  Description of Artificial Sequence: Synthetic coding sequence
atgcacagcctggccaccgccgcccccgtgcccaccaccctggcccaggtggacagagagaagatctaccagtggatcaacgagctgagcagccccgagaccagagagaacgccctgctggagctgagcaagaagagagagagcgtgcccgacctggcccccatgctgtggcacagcttcggcaccatcgccgccctgctgcaggagatcgtgaacatctaccccagcatcaacccccccaccctgaccgcccaccagagcaacagagtgtgcaacgccctggccctgctgcagtgcgtggccagccaccccgagaccagaagcgccttcctggccgcccacatccccctgttcctgtaccccttcctgcacaccgtgagcaagaccagacccttcgagtacctgagactgaccagcctgggcgtgatcgtggagaccggcttccaccacgtgggccaggccgacctggagctgcccaccagcagcgacctgcccgccagcgccagccagagcgccggcatcaccggcgccctggtgaagaccgacgagcaggaggtgatcaacttcctgctgaccaccgagatcatccccctgtgcctgagaatcatggagagcggcagcgagctgagcaagaccgtggccaccttcatcctgcagaagatcctgctggacgacaccggcctggcctacatctgccagacctacgagagattcagccacgtggccatgatcctgggcaagatggtgctgcagctgagcaaggagcccagcgccagactgctgaagcacgtggtgagatgctacctgagactgagcgacaaccccagagccagagaggccctgagacagtgcctgcccgaccagctgaaggacaccaccttcgcccaggtgctgaaggacgacaccaccaccaagagatggctggcccagctggtgaagaacctgcaggagggccaggtgaccgaccccagaggcatccccctgcccccccagtag

SEQ ID NO: 96476 - DNA, 900 bp, Artificial Sequence; identical to SEQ ID NO: 96474
  Description of Artificial Sequence: Synthetic coding sequence

SEQ ID NO: 96477 - DNA, 777 bp, Artificial Sequence
  Description of Artificial Sequence: Synthetic coding sequence
atgcacagcctggccaccgccgcccccgtgcccaccaccctggcccaggtggacagagagaagatctaccagtggatcaacgagctgagcagccccgagaccagagagaacgccctgctggagctgagcaagaagagagagagcgtgcccgacctggcccccatgctgtggcacagcttcggcaccatcgccgccctgctgcaggagatcgtgaacatctaccccagcatcaacccccccaccctgaccgcccaccagagcaacagagtgtgcaacgccctggccctgctgcagtgcgtggccagccaccccgagaccagaagcgccttcctggccgcccacatccccctgttcctgtaccccttcctgcacaccgtgagcaagaccagacccttcgagtacctgagactgaccagcctgggcgtgatcggcgccctggtgaagaccgacgagcaggaggtgatcaacttcctgctgaccaccgagatcatccccctgtgcctgagaatcatggagagcggcagcgagctgagcaagaccgtggccaccttcatcctgcagaagatcctgctggacgacaccggcctggcctacatctgccagacctacgagagattcagccacgtggccatgatcctgggcaagatggtgctgcagctgagcaaggagcccagcgccagactgctgaagcacgtggtgagatgctacctgagactgagcgacaaccccagattcagcgacctgaccttctgctggagcagcttccagagaaagtag

SEQ ID NO: 96478 - DNA, 990 bp, Artificial Sequence
  Description of Artificial Sequence: Synthetic coding sequence
atggccgccctgggcggcgacggcctgagactgctgagcgtgagcagacccgagagaccccccgagagcgccgccctgggcggcctgggccccggcctgtgctgctgggtgagcgtgttcagctgcctgagcctggcctgcagctacgtgggcagcctgtacgtgtggaagagcgagctgcccagagaccaccccgccgtgatcaagagaagattcaccagcgtgctggtggtgagcagcctgagccccctgtgcgtgctgctgtggagagagctgaccggcatccagcccggcaccagcctgctgaccctgatgggcttcagactggagggcatcttccccgccgccctgctgcccctgctgctgaccatgatcctgttcctgggccccctgatgcagctgagcatggactgcccctgcgacctggccgacggcctgaaggtggtgctggcccccagaagctgggccagatgcctgaccgacatgagatggctgagaaaccaggtgatcgcccccctgaccgaggagctggtgttcagagcctgcatgctgcccatgctggccccctgcatgggcctgggccccgccgtgttcacctgccccctgttcttcggcgtggcccacttccaccacatcatcgagcagctgagattcagacagagcagcgtgggcaacatcttcctgagcgccgccttccagttcagctacaccgccgtgttcggcgcctacaccgccttcctgttcatcagaaccggccacctgatcggccccgtgctgtgccacagcttctgcaactacatgggcttccccgccgtgtgcgccgccctggagcacccccagagaagacccctgctggccggctacgccctgggcgtgggcctgttcctgctgctgctgcagcccctgaccgaccccaagctgtacggcagcctgcccctgtgcgtgctgctggagagagccggcgacagcgaggcccccctgtgcagctag

SEQ ID NO: 96479 - DNA, 927 bp, Artificial Sequence
  Description of Artificial Sequence: Synthetic coding sequence
atggccgccctgggcggcgacggcctgagactgctgagcgtgagcagacccgagagaccccccgagagcgccgccctgggcggcctgggccccggcctgtgctgctgggtgagcgtgttcagctgcctgagcctggcctgcagctacgtgggcagcctgtacgtgtggaagagcgagctgcccagagaccaccccgccgtgatcaagagaagattcaccagcgtgctggtggtgagcagcctgagccccctgtgcgtgctgctgtggagagagctgaccggcatccagcccggcaccagcctgctgaccctgatgggcttcagactggagggcatcttccccgccgccctgctgcccctgctgctgaccatgatcctgttcctgggccccctgatgcagctgagcatggactgcccctgcgacctggccgacggcctgaaggtggtgctggcccccagaagctgggccagatgcctgaccgacatgagatggctgagaaaccaggtgatcgcccccctgaccgaggagctggtgttcagagcctgcatgctgcccatgctggccccctgcatgggcctgggccccgccgtgttcacctgccccctgttcttcggcgtggcccacttccaccacatcatcgagcagctgagattcagacagagcagcgtgggcaacatcttcctgagcgccggccacctgatcggccccgtgctgtgccacagcttctgcaactacatgggcttccccgccgtgtgcgccgccctggagcacccccagagaagacccctgctggccggctacgccctgggcgtgggcctgttcctgctgctgctgcagcccctgaccgaccccaagctgtacggcagcctgcccctgtgcgtgctgctggagagagccggcgacagcgaggcccccctgtgcagctag

SEQ ID NO: 96480 - DNA, 1164 bp, Artificial Sequence
  Description of Artificial Sequence: Synthetic coding sequence
atggtgcccaagggcgccaccatgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcttcgtgagcagcagcgacagactgagagagctgggccccgacggcgaggaggccgagggccccggcgccggcgacggcccccccagaagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccttcagaagaagcgacagcttccccgagagaagagcccccagaaagggcaacaccctgtacgtgtacggcgaggacatgacccccaccctgctgagaggcgccttcagccccttcggcaacatcatcgacctgagcatggacccccccagaaactgcgccttcgtgacctacgagaagatggagagcgccgaccaggccgtggccgagctgaacggcacccaggtggagagcgtgcagctgaaggtgaacatcgccagaaagcagcccatgctggacgccgccaccggcaagagcgtgtggggcagcctggccgtgcagaacagccccaagggctgccacagagacaagagaacccagatcgtgtacagcgacgacgtgtacaaggagaacctggtggacggcttctag

SEQ ID NO: 96481 - DNA, 1143 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcttcgtgagcagcagcgacagactgagagagctgggccccgacggcgaggaggccgagggccccggcgccggcgacggcccccccagaagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccttcagaagaagcgacagcttccccgagagaagagcccccagaaagggcaacaccctgtacgtgtacggcgaggacatgacccccaccctgctgagaggcgccttcagccccttcggcaacatcatcgacctgagcatggacccccccagaaactgcgccttcgtgacctacgagaagatggagagcgccgaccaggccgtggccgagctgaacggcacccaggtggagagcgtgcagctgaaggtgaacatcgccagaaagcagcccatgctggacgccgccaccggcaagagcgtgtggggcagcctggccgtgcagaacagccccaagggctgccacagagacaagagaacccagatcgtgtacagcgacgacgtgtacaaggagaacctggtggacggcttctag

SEQ ID NO: 96482 - DNA, 1143 bp, Artificial Sequence; identical to SEQ ID NO: 96481
  Description of Artificial Sequence: Synthetic coding sequence

SEQ ID NO: 96483 - DNA, 1143 bp, Artificial Sequence; identical to SEQ ID NO: 96481
  Description of Artificial Sequence: Synthetic coding sequence

SEQ ID NO: 96484 - DNA, 885 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcttcgtgagcagcagcgacagactgagagagctgggccccgacggcgaggaggccgagggccccggcgccggcgacggcccccccagaagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccttcagaagaagcgacagcttccccgagagaagagcccccagaaagggcaacaccctgtacgtgtacggcgaggacatgacccccaccctgctgagaggcgccttcagccccttcggcaacatcatcgacctgagcatggaccccccctag

SEQ ID NO: 96485 - DNA, 480 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcttcgtgagcagcagcgacagactgagagagctgggccccgacggcgaggaggccgagggccccggcgccggctag

SEQ ID NO: 96486 - DNA, 723 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcgacagactgagagagctgggccccgacggcgaggaggccgagggccccggcgccggcgacggcccccccagaagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggcccctag

SEQ ID NO: 96487 - DNA, 480 bp, Artificial Sequence; identical to SEQ ID NO: 96485
  Description of Artificial Sequence: Synthetic coding sequence

SEQ ID NO: 96488 - DNA, 480 bp, Artificial Sequence; identical to SEQ ID NO: 96485
  Description of Artificial Sequence: Synthetic coding sequence

SEQ ID NO: 96489 - DNA, 1005 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcgacagactgagagagctgggccccgacggcgaggaggccgagggccccggcgccggcgacggcccccccagaagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccttcagaagaagcgacagcttccccgagagaagagcccccagaaagggcaacaccctgtacgtgtacggcgaggacatgacccccaccctgctgagaggcgccttcagccccttcggcaacatcatcgacctgagcatggacccccccagaaactgcgccttcgtgacctacgagaagatggagagcgccgaccaggccgtggccgagctgaacggcacccaggtggagagcgtgcagctgaaggtgaacatcgccagaaagcagcccatgctggacgccgcctag

SEQ ID NO: 96490 - DNA, 723 bp, Artificial Sequence; identical to SEQ ID NO: 96486
  Description of Artificial Sequence: Synthetic coding sequence

SEQ ID NO: 96491 - DNA, 480 bp, Artificial Sequence; identical to SEQ ID NO: 96485
  Description of Artificial Sequence: Synthetic coding sequence

SEQ ID NO: 96492 - DNA, 1005 bp, Artificial Sequence; identical to SEQ ID NO: 96489
  Description of Artificial Sequence: Synthetic coding sequence

SEQ ID NO: 96493 - DNA, 480 bp, Artificial Sequence; identical to SEQ ID NO: 96485
  Description of Artificial Sequence: Synthetic coding sequence

SEQ ID NO: 96494 - DNA, 1143 bp, Artificial Sequence; identical to SEQ ID NO: 96481
  Description of Artificial Sequence: Synthetic coding sequence

SEQ ID NO: 96495 - DNA, 885 bp, Artificial Sequence; identical to SEQ ID NO: 96484
  Description of Artificial Sequence: Synthetic coding sequence

SEQ ID NO: 96496 - DNA, 723 bp, Artificial Sequence; identical to SEQ ID NO: 96486
  Description of Artificial Sequence: Synthetic coding sequence

SEQ ID NO: 96497 - DNA, 885 bp, Artificial Sequence; identical to SEQ ID NO: 96484
  Description of Artificial Sequence: Synthetic coding sequence

SEQ ID NO: 96498 - DNA, 1005 bp, Artificial Sequence; identical to SEQ ID NO: 96489
  Description of Artificial Sequence: Synthetic coding sequence

SEQ ID NO: 96499 - DNA, 1005 bp, Artificial Sequence; identical to SEQ ID NO: 96489
  Description of Artificial Sequence: Synthetic coding sequence

SEQ ID NO: 96500 - DNA, 1005 bp, Artificial Sequence; identical to SEQ ID NO: 96489
  Description of Artificial Sequence: Synthetic coding sequence

SEQ ID NO: 96501 - DNA, 1053 bp, Artificial Sequence
  Description of Artificial Sequence: Synthetic coding sequence
atgctggtgatcccccccggcctgagcgaggaggaggaggccctgcagaagaagttcaacaagctgaagaagaagaagaaggccctgctggccctgaagaagcagagcagcagcagcaccaccagccagggcggcgtgaagagaagcctgagcgagcagcccgtgatggacaccgccaccgccaccgagcaggccaagcagctggtgaagagcggcgccatcagcgccatcaaggccgagaccaagaacagcggcttcaagagaagcagaaccctggagggcaagctgaaggaccccgagaagggccccgtgcccaccttccagcccttccagagaagcatcagcgccgacgacgacctgcaggagagcagcagaagaccccagagaaagagcctgtacgagagcttcgactggggctacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccttcagaagaagcgacagcttccccgagagaagagcccccagaaagggcaacaccctgtacgtgtacggcgaggacatgacccccaccctgctgagaggcgccttcagccccttcggcaacatcatcgacctgagcatggacccccccagaaactgcgccttcgtgacctacgagaagatggagagcgccgaccaggccgtggccgagctgaacggcacccaggtggagagcgtgcagctgaaggtgaacatcgccagaaagcagcccatgctggacgccgccaccggcaagagcgtgtggggcagcctggccgtgcagaacagccccaagggctgccacagagacaagagaacccagatcgtgtacagcgacgacgtgtacaaggagaacctggtggacggcttctag

SEQ ID NO: 96502 - DNA, 1143 bp, Artificial Sequence; identical to SEQ ID NO: 96481
  Description of Artificial Sequence: Synthetic coding sequence

SEQ ID NO: 96503 - DNA, 723 bp, Artificial Sequence; identical to SEQ ID NO: 96486
  Description of Artificial Sequence: Synthetic coding sequence

SEQ ID NO: 96504 - DNA, 1005 bp, Artificial Sequence; identical to SEQ ID NO: 96489
  Description of Artificial Sequence: Synthetic coding sequence

SEQ ID NO: 96505 - DNA, 885 bp, Artificial Sequence; identical to SEQ ID NO: 96484
  Description of Artificial Sequence: Synthetic coding sequence

SEQ ID NO: 96506 - DNA, 885 bp, Artificial Sequence; identical to SEQ ID NO: 96484
  Description of Artificial Sequence: Synthetic coding sequence

SEQ ID NO: 96507 - DNA, 885 bp, Artificial Sequence; identical to SEQ ID NO: 96484
  Description of Artificial Sequence: Synthetic coding sequence

SEQ ID NO: 96508 - DNA, 723 bp, Artificial Sequence; identical to SEQ ID NO: 96486
  Description of Artificial Sequence: Synthetic coding sequence

SEQ ID NO: 96509 - DNA, 1143 bp, Artificial Sequence; identical to SEQ ID NO: 96481
  Description of Artificial Sequence: Synthetic coding sequence

SEQ ID NO: 96510 - DNA, 480 bp, Artificial Sequence; identical to SEQ ID NO: 96485
  Description of Artificial Sequence: Synthetic coding sequence

SEQ ID NO: 96511 - DNA, 1164 bp, Artificial Sequence; identical to SEQ ID NO: 96480
  Description of Artificial Sequence: Synthetic coding sequence

SEQ ID NO: 96512 - DNA, 1164 bp, Artificial Sequence; identical to SEQ ID NO: 96480
  Description of Artificial Sequence: Synthetic coding sequence

SEQ ID NO: 96513 - DNA, 1164 bp, Artificial Sequence; identical to SEQ ID NO: 96480
  Description of Artificial Sequence: Synthetic coding sequence

SEQ ID NO: 96514 - DNA, 1164 bp, Artificial Sequence; identical to SEQ ID NO: 96480
  Description of Artificial Sequence: Synthetic coding sequence

SEQ ID NO: 96515 - DNA, 1164 bp, Artificial Sequence; identical to SEQ ID NO: 96480
  Description of Artificial Sequence: Synthetic coding sequence

SEQ ID NO: 96516 - DNA, 3294 bp, Artificial Sequence
  Description of Artificial Sequence: Synthetic coding sequence
atggccacccaggtgatgggccagagcagcggcggcggcggcctgttcaccagcagcggcaacatcggcatggccctgcccaacgacatgtacgacctgcacgacctgagcaaggccgagctggccgccccccagctgatcatgctggccaacgtggccctgaccggcgaggtgaacggcagctgctgcgactacctggtgggcgaggagagacagatggccgagctgatgcccgtgggcgacaacaacttcagcgacagcgaggagggcgagggcctggaggagagcgccgacatcaagggcgagccccacggcctggagaacatggagctgagaagcctggagctgagcgtggtggagccccagcccgtgttcgaggccagcggcgcccccgacatctacagcagcaacaaggacctgccccccgagacccccggcgccgaggacaagggcaagagcagcaagaccaagcccttcagatgcaagccctgccagtacgaggccgagagcgaggagcagttcgtgcaccacatcagagtgcacagcgccaagaagttcttcgtggaggagagcgccgagaagcaggccaaggccagagagagcggcagcagcaccgccgaggagggcgacttcagcaagggccccatcagatgcgacagatgcggctacaacaccaacagatacgaccactacaccgcccacctgaagcaccacaccagagccggcgacaacgagagagtgtacaagtgcatcatctgcacctacaccaccgtgagcgagtaccactggagaaagcacctgagaaaccacttccccagaaaggtgtacacctgcggcaagtgcaactacttcagcgacagaaagaacaactacgtgcagcacgtgagaacccacaccggcgagagaccctacaagtgcgagctgtgcccctacagcagcagccagaagacccacctgaccagacacatgagaacccacagcggcgagaagcccttcaagtgcgaccagtgcagctacgtggccagcaaccagcacgaggtgaccagacacgccagacaggtgcacaacggccccaagcccctgaactgcccccactgcgactacaagaccgccgacagaagcaacttcaagaagcacgtggagctgcacgtgaaccccagacagttcaactgccccgtgtgcgactacgccgccagcaagaagtgcaacctgcagtaccacttcaagagcaagcaccccacctgccccaacaagaccatggacgtgagcaaggtgaagctgaagaagaccaagaagagagaggccgacctgcccgacaacatcaccaacgagaagaccgagatcgagcagaccaagatcaagggcgacgtggccggcaagaagaacgagaagagcgtgaaggccgagaagagagacgtgagcaaggagaagaagcccagcaacaacgtgagcgtgatccaggtgaccaccagaaccagaaagagcgtgaccgaggtgaaggagatggacgtgcacaccggcagcaacagcgagaagttcagcaagaccaagaagagcaagagaaagctggaggtggacagccacagcctgcacggccccgtgaacgacgaggagagcagcaccaagaagaagaagaaggtggagagcaagagcaagaacaacagccaggaggtgcccaagggcgacagcaaggtggaggagaacaagaagcagaacacctgcatgaagaagagcaccaagaagaagaccctgaagaacaagagcagcaagaagagcagcaagcccccccagaaggagcccgtggagaagggcagcgcccagatggaccccccccagatgggccccgcccccaccgaggccgtgcagaagggccccgtgcaggtggagccccccccccccatggagcacgcccagatggagggcgcccagatcagacccgcccccgacgagcccgtgcagatggaggtggtgcaggagggccccgcccagaaggagctgctgccccccgtggagcccgcccagatggtgggcgcccagatcgtgctggcccacatggagctgcccccccccatggagaccgcccagaccgaggtggcccagatgggccccgcccccatggagcccgcccagatggaggtggcccaggtggagagcgcccccatgcaggtggtgcagaaggagcccgtgcagatggagctgagcccccccatggaggtggtgcagaaggagcccgtgcagatcgagctgagcccccccatggaggtggtgcagaaggagcccgtgaagatcgagctgagcccccccatcgaggtggtgcagaaggagcccgtgcagatggagctgagcccccccatgggcgtggtgcagaaggagcccgcccagagagagccccccccccccagagagccccccctgcacatggagcccatcagcaagaagccccccctgagaaaggacaagaaggagaagagcaacatgcagagcgagagagccagaaaggagcaggtgctgatcgaggtgggcctggtgcccgtgaaggacagctggctgctgaaggagagcgtgagcaccgaggacctgagcccccccagcccccccctgcccaaggagaacctgagagaggaggccagcggcgaccagaagctgctgaacaccggcgagggcaacaaggaggcccccctgcagaaggtgggcgccgaggaggccgacgagagcctgcccggcctggccgccaacatcaacgagagcacccacatcagcagcagcggccagaacctgaacacccccgagggcgagaccctgaacggcaagcaccagaccgacagcatcgtgtgcgagatgaagatggacaccgaccagaacaccagagagaacctgaccggcatcaacagcaccgtggaggagcccgtgagccccatgctgccccccagcgccgtggaggagagagaggccgtgagcaagaccgccctggccagcccccccgccaccatggccgccaacgagagccaggagatcgacgaggacgagggcatccacagccacgagggcagcgacctgagcgacaacatgagcgagggcagcgacgacagcggcctgcacggcgccagacccgtgccccaggagagcagcagaaagaacgccaaggaggccctggccgtgaaggccgccaagggcgacttcgtgtgcatcttctgcgacagaagcttcagaaagggcaaggactacagcaagcacctgaacagacacctggtgaacgtgtactacctggaggaggccgcccagggccaggagtag

SEQ ID NO: 96517 - DNA, 3225 bp, Artificial Sequence
  Description of Artificial Sequence: Synthetic coding sequence
atggccacccaggtgatgggccagagcagcggcggcggcggcctgttcaccagcagcggcaacatcggcatggccctgcccaacgacatgtacgacctgcacgacctgagcaaggccgagctggccgccccccagctgatcatgctggccaacgtggccctgaccggcgaggtgaacggcagctgctgcgactacctggtgggcgaggagagacagatggccgagctgatgcccgtgggcgacaacaacttcagcgacagcgaggagggcgagggcctggaggagagcgccgacatcaagggcgagccccacggcctggagaacatggagctgagaagcctggagctgagcgtggtggagccccagcccgtgttcgaggccagcggcgcccccgacatctacagcagcaacaaggacctgccccccgagacccccggcgccgaggacaagggcaagagcagcaagaccaagcccttcagatgcaagccctgccagtacgaggccgagagcgaggagcagttcgtgcaccacatcagagtgcacagcgccaagaagttcttcgtggaggagagcgccgagaagcaggccaaggccagagagagcggcagcagcaccgccgaggagggcgacttcagcaagggccccatcagatgcgacagatgcggctacaacaccaacagatacgaccactacaccgcccacctgaagcaccacaccagagccggcgacaacgagagagtgtacaagtgcatcatctgcacctacaccaccgtgagcgagtaccactggagaaagcacctgagaaaccacttccccagaaaggtgtacacctgcggcaagtgcaactacttcagcgacagaaagaacaactacgtgcagcacgtgagaacccacaccggcaagagacccagcggcgagaagcccttcaagtgcgaccagtgcagctacgtggccagcaaccagcacgaggtgaccagacacgccagacaggtgcacaacggccccaagcccctgaactgcccccactgcgactacaagaccgccgacagaagcaacttcaagaagcacgtggagctgcacgtgaaccccagacagttcaactgccccgtgtgcgactacgccgccagcaagaagtgcaacctgcagtaccacttcaagagcaagcaccccacctgccccaacaagaccatggacgtgagcaaggtgaagctgaagaagaccaagaagagagaggccgacctgcccgacaacatcaccaacgagaagaccgagatcgagcagaccaagatcaagggcgacgtggccggcaagaagaacgagaagagcgtgaaggccgagaagagagacgtgagcaaggagaagaagcccagcaacaacgtgagcgtgatccaggtgaccaccagaaccagaaagagcgtgaccgaggtgaaggagatggacgtgcacaccggcagcaacagcgagaagttcagcaagaccaagaagagcaagagaaagctggaggtggacagccacagcctgcacggccccgtgaacgacgaggagagcagcaccaagaagaagaagaaggtggagagcaagagcaagaacaacagccaggaggtgcccaagggcgacagcaaggtggaggagaacaagaagcagaacacctgcatgaagaagagcaccaagaagaagaccctgaagaacaagagcagcaagaagagcagcaagcccccccagaaggagcccgtggagaagggcagcgcccagatggaccccccccagatgggccccgcccccaccgaggccgtgcagaagggccccgtgcaggtggagccccccccccccatggagcacgcccagatggagggcgcccagatcagacccgcccccgacgagcccgtgcagatggaggtggtgcaggagggccccgcccagaaggagctgctgccccccgtggagcccgcccagatggtgggcgcccagatcgtgctggcccacatggagctgcccccccccatggagaccgcccagaccgaggtggcccagatgggccccgcccccatggagcccgcccagatggaggtggcccaggtggagagcgcccccatgcaggtggtgcagaaggagcccgtgcagatggagctgagcccccccatggaggtggtgcagaaggagcccgtgcagatcgagctgagcccccccatggaggtggtgcagaaggagcccgtgaagatcgagctgagcccccccatcgaggtggtgcagaaggagcccgtgcagatggagctgagcccccccatgggcgtggtgcagaaggagcccgcccagagagagccccccccccccagagagccccccctgcacatggagcccatcagcaagaagccccccctgagaaaggacaagaaggagaagagcaacatgcagagcgagagagccagaaaggagcaggtgctgatcgaggtgggcctggtgcccgtgaaggacagctggctgctgaaggagagcgtgagcaccgaggacctgagcccccccagcccccccctgcccaaggagaacctgagagaggaggccagcggcgaccagaagctgctgaacaccggcgagggcaacaaggaggcccccctgcagaaggtgggcgccgaggaggccgacgagagcctgcccggcctggccgccaacatcaacgagagcacccacatcagcagcagcggccagaacctgaacacccccgagggcgagaccctgaacggcaagcaccagaccgacagcatcgtgtgcgagatgaagatggacaccgaccagaacaccagagagaacctgaccggcatcaacagcaccgtggaggagcccgtgagccccatgctgccccccagcgccgtggaggagagagaggccgtgagcaagaccgccctggccagcccccccgccaccatggccgccaacgagagccaggagatcgacgaggacgagggcatccacagccacgagggcagcgacctgagcgacaacatgagcgagggcagcgacgacagcggcctgcacggcgccagacccgtgccccaggagagcagcagaaagaacgccaaggaggccctggccgtgaaggccgccaagggcgacttcgtgtgcatcttctgcgacagaagcttcagaaagggcaaggactacagcaagcacctgaacagacacctggtgaacgtgtactacctggaggaggccgcccagggccaggagtag

SEQ ID NO: 96518 - DNA, 1383 bp, Artificial Sequence
  Description of Artificial Sequence: Synthetic coding sequence
atggccacccaggtgatgggccagagcagcggcggcggcggcctgttcaccagcagcggcaacatcggcatggccctgcccaacgacatgtacgacctgcacgacctgagcaaggccgagctggccgccccccagctgatcatgctggccaacgtggccctgaccggcgaggtgaacggcagctgctgcgactacctggtgggcgaggagagacagatggccgagctgatgcccgtgggcgacaacaacttcagcgacagcgaggagggcgagggcctggaggagagcgccgacatcaagggcgagccccacggcctggagaacatggagctgagaagcctggagctgagcgtggtggagccccagcccgtgttcgaggccagcggcgcccccgacatctacagcagcaacaaggacctgccccccgagacccccggcgccgaggacaagggcaagagcagcaagaccaagcccttcagatgcaagccctgccagtacgaggccgagagcgaggagcagttcgtgcaccacatcagagtgcacagcgccaagaagttcttcgtggaggagagcgccgagaagcaggccaaggccagagagagcggcagcagcaccgccgaggagggcgacttcagcaagggccccatcagatgcgacagatgcggctacaacaccaacagatacgaccactacaccgcccacctgaagcaccacaccagagccggcgacaacgagagagtgtacaagtgcatcatctgcacctacaccaccgtgagcgagtaccactggagaaagcacctgagaaaccacttccccagaaaggtgtacacctgcggcaagtgcaactacttcagcgacagaaagaacaactacgtgcagcacgtgagaacccacaccggcgagagaccctacaagtgcgagctgtgcccctacagcagcagccagaagacccacctgaccagacacatgagaacccacagcggcgagaagcccttcaagtgcgaccagtgcagctacgtggccagcaaccagcacgaggtgaccagacacgccagacaggtgcacaacggccccaagcccctgaactgcccccactgcgactacaagaccgccgacagaagcaacttcaagaagcacgtggagctgcacgtgaaccccagacagttcaactgccccgtgtgcgactacgccgccagcaagaagtgcaacctgcagtaccacttcaagagcaagcaccccacctgccccaacaagaccatggacgtgagcaaggtgaagctgaagaagaccaagaagagagaggccgacctgcccgacaacatcaccaacgagaagaccgagatcgagcagaccaagaagaagaagaagaagaagaagaagtag

SEQ ID NO: 96519 - DNA, 5745 bp, Artificial Sequence
  Description of Artificial Sequence: Synthetic coding sequence
atggccgacggcaagggcgacgccgccgccgtggccggcgccggcgccgaggcccccgccgtggccggcgccggcgacggcgtggagaccgagagcatggtgagaggccacagacccgtgagccccgcccccggcgccagcggcctgagaccctgcctgtggcagctggagaccgagctgagagagcaggaggtgagcgaggtgagcagcctgaactactgcagaagcttctgccagaccctgctgcagtacgccagcaacaagaacgccagcgagcacatcgtgtacctgctggaggtgtacagactggccatccagagcttcgccagcgccagaccctacctgaccaccgagtgcgaggacgtgctgctggtgctgggcagactggtgctgagctgcttcgagctgctgctgagcgtgagcgagagcgagctgccctgcgaggtgtggctgcccttcctgcagagcctgcaggagagccacgacgccctgctggagttcggcaacaacaacctgcagatcctggtgcacgtgaccaaggagggcgtgtggaagaaccccgtgctgctgaagatcctgagccagcagcccgtggagaccgaggaggtgaacaagctgatcgcccaggagggccccagcttcctgcagatgagaatcaagcacctgctgaagagcaactgcatcccccaggccaccgccctgagcaagctgtgcgccgagagcaaggagatcagcaacgtgagcagcttccagcaggcctacatcacctgcctgtgcagcatgctgcccaacgaggacgccatcaaggagatcgccaaggtggactgcaaggaggtgctggacatcatctgcaacctggagagcgagggccaggacaacaccgccttcgtgctgtgcaccacctacctgacccagcagctgcagaccgccagcgtgtactgcagctgggagctgaccctgttctggagcaagctgcagagaagaatcgaccccagcctggacaccttcctggagagatgcagacagttcggcgtgatcgccaagacccagcagcacctgttctgcctgatcagagtgatccagaccgaggcccaggacgccggcctgggcgtgagcatcctgctgtgcgtgagagccctgcagctgagaagcagcgaggacgaggagatgaaggccagcgtgtgcaagaccatcgcctgcctgctgcccgaggacctggaggtgagaagagcctgccagctgaccgagttcctgatcgagcccagcctggacggcttcaacatgctggaggagctgtacctgcagcccgaccagaagttcgacgaggagaacgcccccgtgcccaacagcctgagatgcgagctgctgctggccctgaaggcccactggcccttcgaccccgagttctgggactggaagaccctgaagagacactgccaccagctgctgggccaggaggccagcgacagcgacgacgacctgagcggctacgagatgagcatcaacgacaccgacgtgctggagagcttcctgagcgactacgacgagggcaaggaggacaagcagtacagaagaagagacctgaccgaccagcacaaggagaagagagacaagaagcccatcggcagcagcgagagataccagagatggctgcagtacaagttcttctgcctgctgtgcaagagagagtgcatcgaggccagaatcctgcaccacagcaagatgcacatggaggacggcatctacacctgccccgtgtgcatcaagaagttcaagagaaaggagatgttcgtgccccacgtgatggagcacgtgaagatgccccccagcagaagagacagaagcaagaagaagctgctgctgaagggcagccagaagggcatctgccccaagagccccagcgccatccccgagcagaaccacagcctgaacgaccaggccaagggcgagagccacgagtacgtgaccttcagcaagctggaggactgccacctgcaggacagagacctgtacccctgccccggcaccgactgcagcagagtgttcaagcagttcaagtacctgagcgtgcacctgaaggccgagcaccagaacaacgacgagaacgccaagcactacctggacatgaagaacagaagagagaagtgcacctactgcagaagacacttcatgagcgccttccacctgagagagcacgagcaggtgcactgcggcccccagccctacatgtgcgtgagcatcgactgctacgccagattcggcagcgtgaacgagctgctgaaccacaagcagaagcacgacgacctgagatacaagtgcgagctgaacggctgcaacatcgtgttcagcgacctgggccagctgtaccaccacgaggcccagcacttcagagacgccagctacacctgcaacttcctgggctgcaagaagttctactacagcaagatcgagtaccagaaccacctgagcatgcacaacgtggagaacagcaacggcgacatcaagaagagcgtgaagctggaggagagcgccaccggcgagaagcaggactgcatcaaccagccccacctgctgaaccagaccgacaagagccacctgcccgaggacctgttctgcgccgagagcgccaacagccagatcgacaccgagaccgccgagaacctgaaggagaacagcgacagcaacagcagcgaccagctgagccacagcagcagcgccagcatgaacgaggagctgatcgacaccctggaccacagcgagaccatgcaggacgtgctgctgagcaacgagaaggtgttcggccccagcagcctgaaggagaagtgcagcagcatggccgtgtgcttcgacggcaccaagttcacctgcggcttcgacggctgcggcagcacctacaagaacgccagaggcatgcagaagcacctgagaaaggtgcacccctaccacttcaagcccaagaagatcaagaccaaggacctgttccccagcctgggcaacgagcacaaccagaccaccgagaagctggacgccgagcccaagccctgcagcgacaccaacagcgacagccccgacgagggcctggaccacaacatccacatcaagtgcaagagagagcaccagggctacagcagcgagagcagcatctgcgccagcaagagaccctgcaccgaggacaccatgctggagctgctgctgagactgaagcacctgagcctgaagaacagcatcacccacggcagcttcagcggcagcctgcagggctaccccagcagcggcgccaagagcctgcagagcgtgagcagcatcagcgacctgaacttccagaaccaggacgagaacatgcccagccagtacctggcccagctggccgccaagcccttcttctgcgagctgcagggctgcaagtacgagttcgtgaccagagaggccctgctgatgcactacctgaagaagcacaactacagcaaggagaaggtgctgcagctgaccatgttccagcacagatacagccccttccagtgccacatctgccagagaagcttcaccagaaagacccacctgagaatccactacaagaacaagcaccagatcggcagcgacagagccacccacaagctgctggacaacgagaagtgcgaccacgagggcccctgcagcgtggacagactgaagggcgactgcagcgccgagctgggcggcgaccccagcagcaacagcgagaagccccactgccaccccaagaaggacgagtgcagcagcgagaccgacctggagagcagctgcgaggagaccgagagcaagaccagcgacatcagcagccccatcggcagccacagagaggagcaggagggcagagagggcagaggcagcagaagaaccgtggccaagggcaacctgtgctacatcctgaacaagtaccacaagcccttccactgcatccacaagacctgcaacagcagcttcaccaacctgaagggcctgatcagacactacagaaccgtgcaccagtacaacaaggagcagctgtgcctggagaaggacaaggccagaaccaagagagagctggtgaagtgcaagaagatcttcgcctgcaagtacaaggagtgcaacaagagattcctgtgcagcaaggccctggccaagcactgcagcgacagccacaacctggaccacatcgaggagcccaaggtgctgagcgaggccggcagcgccgccagattcagctgcaaccagccccagtgccccgccgtgttctacaccttcaacaagctgaagcaccacctgatggagcagcacaacatcgagggcgagatccacagcgactacgagatccactgcgacctgaacggctgcggccagatcttcacccacagaagcaactacagccagcacgtgtactacagacacaaggactactacgacgacctgttcagaagccagaaggtggccaacgagagactgctgagaagcgagaaggtgtgccagaccgccgacacccagggccacgagcaccagaccaccagaagaagcttcaacgccaagagcaagaagtgcggcctgatcaaggagaagaaggcccccatcagcttcaagaccagagccgaggccctgcacatgtgcgtggagcacagcgagcacacccagtacccctgcatggtgcagggctgcctgagcgtggtgaagctggagagcagcatcgtgagacactacaagagaacccaccagatgagcagcgcctacctggagcagcagatggagaacctggtggtgtgcgtgaagtacggcaccaagatcaaggaggagccccccagcgaggccgacccctgcatcaagaaggaggagaacagaagctgcgagagcgagagaaccgagcacagccacagccccggcgacagcagcgcccccatccagaacaccgactgctgccacagcagcgagagagacggcggccagaagggctgcatcgagagcagcagcgtgttcgacgccgacaccctgctgtacagaggcaccctgaagtgcaaccacagcagcaagaccaccagcctggagcagtgcaacatcgtgcagcccccccccccctgcaagatcgagaacagcatccccaaccccaacggcaccgagagcggcacctacttcaccagcttccagctgcccctgcccagaatcaaggagagcgagaccagacagcacagcagcggccaggagaacaccgtgaagaaccccacccacgtgcccaaggagaacttcagaaagcacagccagcccagaagcttcgacctgaagacctacaagcccatgggcttcgagagcagcttcctgaagttcatccaggagagcgaggagaaggaggacgacttcgacgactgggagcccagcgagcacctgaccctgagcaacagcagccagagcagcaacgacctgaccggcaacgtggtggccaacaacatggtgaacgacagcgagcccgaggtggacatcccccacagcagcagcgacagcaccatccacgagaacctgaccgccatcccccccctgatcgtggccgagaccaccaccgtgcccagcctggagaacctgagagtggtgctggacaaggccctgaccgactgcggcgagctggccctgaagcagctgcactacctgagacccgtggtggtgctggagagaagcaagttcagcacccccatcctggacctgttccccaccaagaagaccgacgagctgtgcgtgggcagcagctag

SEQ ID NO: 96520 - DNA, 4824 bp, Artificial Sequence
  Description of Artificial Sequence: Synthetic coding sequence
atgttctaccacgacctgttctacagagagctgaccctgttctggagcaagctgcagagaagaatcgaccccagcctggacaccttcctggagagatgcagacagttcggcgtgatcgccaagacccagcagcacctgttctgcctgatcagagtgatccagaccgaggcccaggacgccggcctgggcgtgagcatcctgctgtgcgtgagagccctgcagctgagaagcagcgaggacgaggagatgaaggccagcgtgtgcaagaccatcgcctgcctgctgcccgaggacctggaggtgagaagagcctgccagctgaccgagttcctgatcgagcccagcctggacggcttcaacatgctggaggagctgtacctgcagcccgaccagaagttcgacgaggagaacgcccccgtgcccaacagcctgagatgcgagctgctgctggccctgaaggcccactggcccttcgaccccgagttctgggactggaagaccctgaagagacactgccaccagctgctgggccaggaggccagcgacagcgacgacgacctgagcggctacgagatgagcatcaacgacaccgacgtgctggagagcttcctgagcgactacgacgagggcaaggaggacaagcagtacagaagaagagacctgaccgaccagcacaaggagaagagagacaagaagcccatcggcagcagcgagagataccagagatggctgcagtacaagttcttctgcctgctgtgcaagagagagtgcatcgaggccagaatcctgcaccacagcaagatgcacatggaggacggcatctacacctgccccgtgtgcatcaagaagttcaagagaaaggagatgttcgtgccccacgtgatggagcacgtgaagatgccccccagcagaagagacagaagcaagaagaagctgctgctgaagggcagccagaagggcatctgccccaagagccccagcgccatccccgagcagaaccacagcctgaacgaccaggccaagggcgagagccacgagtacgtgaccttcagcaagctggaggactgccacctgcaggacagagacctgtacccctgccccggcaccgactgcagcagagtgttcaagcagttcaagtacctgagcgtgcacctgaaggccgagcaccagaacaacgacgagaacgccaagcactacctggacatgaagaacagaagagagaagtgcacctactgcagaagacacttcatgagcgccttccacctgagagagcacgagcaggtgcactgcggcccccagccctacatgtgcgtgagcatcgactgctacgccagattcggcagcgtgaacgagctgctgaaccacaagcagaagcacgacgacctgagatacaagtgcgagctgaacggctgcaacatcgtgttcagcgacctgggccagctgtaccaccacgaggcccagcacttcagagacgccagctacacctgcaacttcctgggctgcaagaagttctactacagcaagatcgagtaccagaaccacctgagcatgcacaacgtggagaacagcaacggcgacatcaagaagagcgtgaagctggaggagagcgccaccggcgagaagcaggactgcatcaaccagccccacctgctgaaccagaccgacaagagccacctgcccgaggacctgttctgcgccgagagcgccaacagccagatcgacaccgagaccgccgagaacctgaaggagaacagcgacagcaacagcagcgaccagctgagccacagcagcagcgccagcatgaacgaggagctgatcgacaccctggaccacagcgagaccatgcaggacgtgctgctgagcaacgagaaggtgttcggccccagcagcctgaaggagaagtgcagcagcatggccgtgtgcttcgacggcaccaagttcacctgcggcttcgacggctgcggcagcacctacaagaacgccagaggcatgcagaagcacctgagaaaggtgcacccctaccacttcaagcccaagaagatcaagaccaaggacctgttccccagcctgggcaacgagcacaaccagaccaccgagaagctggacgccgagcccaagccctgcagcgacaccaacagcgacagccccgacgagggcctggaccacaacatccacatcaagtgcaagagagagcaccagggctacagcagcgagagcagcatctgcgccagcaagagaccctgcaccgaggacaccatgctggagctgctgctgagactgaagcacctgagcctgaagaacagcatcacccacggcagcttcagcggcagcctgcagggctaccccagcagcggcgccaagagcctgcagagcgtgagcagcatcagcgacctgaacttccagaaccaggacgagaacatgcccagccagtacctggcccagctggccgccaagcccttcttctgcgagctgcagggctgcaagtacgagttcgtgaccagagaggccctgctgatgcactacctgaagaagcacaactacagcaaggagaaggtgctgcagctgaccatgttccagcacagatacagccccttccagtgccacatctgccagagaagcttcaccagaaagacccacctgagaatccactacaagaacaagcaccagatcggcagcgacagagccacccacaagctgctggacaacgagaagtgcgaccacgagggcccctgcagcgtggacagactgaagggcgactgcagcgccgagctgggcggcgaccccagcagcaacagcgagaagccccactgccaccccaagaaggacgagtgcagcagcgagaccgacctggagagcagctgcgaggagaccgagagcaagaccagcgacatcagcagccccatcggcagccacagagaggagcaggagggcagagagggcagaggcagcagaagaaccgtggccaagggcaacctgtgctacatcctgaacaagtaccacaagcccttccactgcatccacaagacctgcaacagcagcttcaccaacctgaagggcctgatcagacactacagaaccgtgcaccagtacaacaaggagcagctgtgcctggagaaggacaaggccagaaccaagagagagctggtgaagtgcaagaagatcttcgcctgcaagtacaaggagtgcaacaagagattcctgtgcagcaaggccctggccaagcactgcagcgacagccacaacctggaccacatcgaggagcccaaggtgctgagcgaggccggcagcgccgccagattcagctgcaaccagccccagtgccccgccgtgttctacaccttcaacaagctgaagcaccacctgatggagcagcacaacatcgagggcgagatccacagcgactacgagatccactgcgacctgaacggctgcggccagatcttcacccacagaagcaactacagccagcacgtgtactacagacacaaggactactacgacgacctgttcagaagccagaaggtggccaacgagagactgctgagaagcgagaaggtgtgccagaccgccgacacccagggccacgagcaccagaccaccagaagaagcttcaacgccaagagcaagaagtgcggcctgatcaaggagaagaaggcccccatcagcttcaagaccagagccgaggccctgcacatgtgcgtggagcacagcgagcacacccagtacccctgcatggtgcagggctgcctgagcgtggtgaagctggagagcagcatcgtgagacactacaagagaacccaccagatgagcagcgcctacctggagcagcagatggagaacctggtggtgtgcgtgaagtacggcaccaagatcaaggaggagccccccagcgaggccgacccctgcatcaagaaggaggagaacagaagctgcgagagcgagagaaccgagcacagccacagccccggcgacagcagcgcccccatccagaacaccgactgctgccacagcagcgagagagacggcggccagaagggctgcatcgagagcagcagcgtgttcgacgccgacaccctgctgtacagaggcaccctgaagtgcaaccacagcagcaagaccaccagcctggagcagtgcaacatcgtgcagcccccccccccctgcaagatcgagaacagcatccccaaccccaacggcaccgagagcggcacctacttcaccagcttccagctgcccctgcccagaatcaaggagagcgagaccagacagcacagcagcggccaggagaacaccgtgaagaaccccacccacgtgcccaaggagaacttcagaaagcacagccagcccagaagcttcgacctgaagacctacaagcccatgggcttcgagagcagcttcctgaagttcatccaggagagcgaggagaaggaggacgacttcgacgactgggagcccagcgagcacctgaccctgagcaacagcagccagagcagcaacgacctgaccggcaacgtggtggccaacaacatggtgaacgacagcgagcccgaggtggacatcccccacagcagcagcgacagcaccatccacgagaacctgaccgccatcccccccctgatcgtggccgagaccaccaccgtgcccagcctggagaacctgagagtggtgctggacaaggccctgaccgactgcggcgagctggccctgaagcagctgcactacctgagacccgtggtggtgctggagagaagcaagttcagcacccccatcctggacctgttccccaccaagaagaccgacgagctgtgcgtgggcagcagctag

SEQ ID NO: 96521 - DNA, 1641 bp, Artificial Sequence
  Description of Artificial Sequence: Synthetic coding sequence
atgttctactaccccaacgtgctgcagagacacaccggctgcttcgccaccatctggctggccgccaccagaggcagcagactggtgaagagagagtacctgagagtgaacgtggtgaagacctgcgaggagatcctgaactacgtgctggtgagagtgcagcccccccagcccggcctgcccagacccagattcagcctgtacctgagcgcccagctgcagatcggcgtgatcagagtgtacagccagcagtgccagtacctggtggaggacatccagcacatcctggagagactgcacagagcccagctgcagatcagaatcgacatggagaccgagctgcccagcctgctgctgcccaaccacctggccatgatggagaccctggaggacgcccccgaccccttcttcggcatgatgagcgtggaccccagactgcccagccccttcgacatcccccagatcagacacctgctggaggccgccatccccgagagagtggaggagatcccccccgaggtgcccaccgagcccagagagcccgagagaatccccgtgaccgtgctgccccccgaggccatcaccatcctggaggccgagcccatcagaatgctggagatcgagggcgagagagagctgcccgaggtgagcagaagagagctggacctgctgatcgccgaggaggaggccatcctgctggagatccccagactgcccccccccgcccccgccgaggtggagggcatcggcgaggccctgggccccgaggagctgagactgaccggctgggagcccggcgccctgctgatggaggtgaccccccccgaggagctgagactgcccgccccccccagccccgagagaagaccccccgtgccccccccccccagaagaagaagaagaagaagactgctgttctgggacaaggagacccagatcagccccgagaagttccaggagcagctgcagaccagagcccactgctgggagtgccccatggtgcagccccccgagagaaccatcagaggccccgccgagctgttcagaacccccaccctgagcggctggctgccccccgagctgctgggcctgtggacccactgcgcccagcccccccccaaggccctgagaagagagctgcccgaggaggccgccgccgaggaggagagaagaaagatcgaggtgcccagcgagatcgaggtgcccagagaggccctggagcccagcgtgcccctgatggtgagcctggagatcagcctggaggccgccgaggaggagaagagcagaatcagcctgatcccccccgaggagagatgggcctggcccgaggtggaggcccccgaggcccccgccctgcccgtggtgcccgagctgcccgaggtgcccatggagatgcccctggtgctgccccccgagctggagctgctgagcctggaggccgtgcacagagccgtggccctggagctgcaggccaacagagagcccgacttcagcagcctggtgagccccctgagccccagaagaatggccgccagagtgttctacctgctgctggtgctgagcgcccagcagatcctgcacgtgaagcaggagaagccctacggcagactgctgatccagcccggccccagattccactag

SEQ ID NO: 96522 - DNA, 1590 bp, Artificial Sequence
  Description of Artificial Sequence: Synthetic coding sequence
atgttctactaccccaacgtgctgcagagacacaccggctgcttcgccaccatctggctggccgccaccagaggcagcagactggtgaagagagagtacctgagagtgaacgtggtgaagacctgcgaggagatcctgaactacgtgctggtgagagtgcagcccccccagcccggcctgcccagacccagattcagcctgtacctgagcgcccagctgcagatcggcgtgatcagagtgtacagccagcagtgccagtacctggtggaggacatccagcacatcctggagagactgcacagagcccagctgcagatcagaatcgacatggagaccgagctgcccagcctgctgctgcccaaccacctggccatgatggagaccctggaggacgcccccgaccccttcttcggcatgatgagcgtggaccccagactgcccagccccttcgacatcccccagatcagacacctgctggaggccgccatccccgagagagtggaggagatcccccccgaggtgcccaccgagcccagagagcccgagagaatccccgtgaccgtgctgccccccgaggccatcaccatcctggaggccgagcccatcagaatgctggagatcgagggcgagagagagctgcccgaggtgagcagaagagagctggacctgctgatcgccgaggaggaggccatcctgctggagatccccagactgcccccccccgcccccgccgaggtggagggcatcggcgaggccctgggccccgaggagctgagactgaccggctgggagcccggcgccctgctgatgagaagaccccccgtgccccccccccccagaagaagaagaagaagaagactgctgttctgggacaaggagacccagatcagccccgagaagttccaggagcagctgcagaccagagcccactgctgggagtgccccatggtgcagccccccgagagaaccatcagaggccccgccgagctgttcagaacccccaccctgagcggctggctgccccccgagctgctgggcctgtggacccactgcgcccagcccccccccaaggccctgagaagagagctgcccgaggaggccgccgccgaggaggagagaagaaagatcgaggtgcccagcgagatcgaggtgcccagagaggccctggagcccagcgtgcccctgatggtgagcctggagatcagcctggaggccgccgaggaggagaagagcagaatcagcctgatcccccccgaggagagatgggcctggcccgaggtggaggcccccgaggcccccgccctgcccgtggtgcccgagctgcccgaggtgcccatggagatgcccctggtgctgccccccgagctggagctgctgagcctggaggccgtgcacagagccgtggccctggagctgcaggccaacagagagcccgacttcagcagcctggtgagccccctgagccccagaagaatggccgccagagtgttctacctgctgctggtgctgagcgcccagcagatcctgcacgtgaagcaggagaagccctacggcagactgctgatccagcccggccccagattccactag

SEQ ID NO: 96523 - DNA, 225 bp, Artificial Sequence
  Description of Artificial Sequence: Synthetic coding sequence
atgttctactaccccaacgtgctgcagagacacaccggctgcttcgccaccatctggctggccgccaccagaggcagcagactggtgaagagagagtacctgagagtgaacgtggtgaagacctgcgaggagatcctgaactacgtgctggtgagagtgcagcccccccagcccggcctgcccagacccagattcagcctgtacctgagcgcccagctgcagtag

SEQ ID NO: 96524 - DNA, 1641 bp, Artificial Sequence; identical to SEQ ID NO: 96521
  Description of Artificial Sequence: Synthetic coding sequence

SEQ ID NO: 96525 - DNA, 699 bp, Artificial Sequence
  Description of Artificial Sequence: Synthetic coding sequence
atggccggcgacaccgaggtgtggaagcagatgttccaggagctgatgagagaggtgaagccctggcacagatggaccctgagacccgacaagggcctgctgcccaacgtgctgaagcccggctggatgcagtaccagcagtggaccttcgccagattccagtgcagcagctgcagcagaaactgggccagcgcccaggtgctggtgctgttccacatgaactggagcgaggagaagagcagaggccaggtgaagatgagagtgttcacccagagatgcaagaagtgcccccagcccctgttcgaggaccccgagttcacccaggagaacatcagcagaatcctgaagaacctggtgttcagaatcctgaagaagtgctacagaggcagattccagctgatcgaggaggtgcccatgatcaaggacatcagcctggagggcccccacaacagcgacaactgcgaggcctgcctgcagggcttctgcgccggccccatccaggtgaccagcctgccccccagccagacccccagagtgcacagcatctacaaggtggaggaggtggtgaagccctgggccagcggcgagaacgtgtacagctacgcctgccagaaccacatctgcagaaacctgagcatcttctgctgctgcgtgatcctgatcgtgatcgtggtgatcgtggtgaagaccgccatctag

SEQ ID NO: 96526 - DNA, 741 bp, Artificial Sequence
  Description of Artificial Sequence: Synthetic coding sequence
atggtggtggacttctggacctgggagcagaccttccaggagctgatccaggaggccaagcccagagccacctggaccctgaagctggacggcaacctgcagctggactgcctggcccagggctggaagcagtaccagcagagagccttcggctggttcagatgcagcagctgccagagaagctgggccagcgcccaggtgcagatcctgtgccacacctactgggagcactggaccagccagggccaggtgagaatgagactgttcggccagagatgccagaagtgcagctggagccagtacgagatgcccgagttcagcagcgacagcaccatgagaatcctgagcaacctggtgcagcacatcctgaagaagtactacggcaacggcaccagaaagagccccgagatgcccgtgatcctggaggtgagcctggagggcagccacgacaccgccaactgcgaggcctgcaccctgggcatctgcggccagggcctgaagagctgcatgaccaagcccagcaagagcctgctgccccacctgaagaccggcaacagcagccccggcatcggcgccgtgtacctggccaaccaggccaagaaccagagcgccgaggccaaggaggccaagggcagcggctacgagaagctgggccccagcagagaccccgaccccctgaacatctgcgtgttcatcctgctgctggtgttcatcgtggtgaagtgcttcaccagcgagtag

SEQ ID NO: 96527 - DNA, 447 bp, Artificial Sequence
  Description of Artificial Sequence: Synthetic coding sequence
atggccagagccctgtgcagactgcccagaagaggcctgtggctgctgctggcccaccacctgttcatgaccaccgcctgccaggaggccaactacggcgccctgctgagagagctgtgcctgacccagttccaggtggacatggaggccgtgggcgagaccctgtggtgcgactggggcagaaccatcagaagctacagagagctggccgactgcacctggcacatggccgagaagctgggctgcttctggcccaacgccgaggtggacagattcttcctggccgtgcacggcagatacttcagaagctgccccatcagcggcagagccgtgagagacccccccggcagcatcctgtaccccttcatcgtggtgcccatcaccgtgaccctgctggtgaccgccctggtggtgtggcagagcaagagaaccgagggcatcgtgtag

SEQ ID NO: 96528 - DNA, 381 bp, Artificial Sequence
  Description of Artificial Sequence: Synthetic coding sequence
atgaccaccgcctgccaggaggccaactacggcgccctgctgagagagctgtgcctgacccagttccaggtggacatggaggccgtgggcgagaccctgtggtgcgactggggcagaaccatcagaagctacagagagctggccgactgcacctggcacatggccgagaagctgggctgcttctggcccaacgccgaggtggacagattcttcctggccgtgcacggcagatacttcagaagctgccccatcagcggcagagccgtgagagacccccccggcagcatcctgtaccccttcatcgtggtgcccatcaccgtgaccctgctggtgaccgccctggtggtgtggcagagcaagagaaccgagggcatcgtgtag

SEQ ID NO: 96529 - DNA, 381 bp, Artificial Sequence; identical to SEQ ID NO: 96528
  Description of Artificial Sequence: Synthetic coding sequence

SEQ ID NO: 96530 - DNA, 381 bp, Artificial Sequence; identical to SEQ ID NO: 96528
  Description of Artificial Sequence: Synthetic coding sequence

SEQ ID NO: 96531 - DNA, 528 bp, Artificial Sequence
  Description of Artificial Sequence: Synthetic coding sequence
atggccagcctgagagtggagagagccggcggccccagactgcccagaaccagagtgggcagacccgccgccctgagactgctgctgctgctgggcgccgtgctgaacccccacgaggccctggcccagcccctgcccaccaccggcacccccggcagcgagggcggcaccgtgaagaactacgagaccgccgtgcagttctgctggaaccactacaaggaccagatggaccccatcgagaaggactggtgcgactgggccatgatcagcagaccctacagcaccctgagagactgcctggagcacttcgccgagctgttcgacctgggcttccccaaccccctggccgagagaatcatcttcgagacccaccagatccacttcgccaactgcagcctggtgcagcccaccttcagcgacccccccgaggacgtgctgctggccatgatcatcgcccccatctgcctgatccccttcctgatcaccctggtggtgtggagaagcaaggacagcgaggcccaggcctag

SEQ ID NO: 96532 - DNA, 447 bp, Artificial Sequence
  Description of Artificial Sequence: Synthetic coding sequence
atggagaccggcgccctgagaagaccccagctgctgcccctgctgctgctgctgtgcggcggctgccccagagccggcggctgcaacgagaccggcatgctggagagactgcccctgtgcggcaaggccttcgccgacatgatgggcaaggtggacgtgtggaagtggtgcaacctgagcgagttcatcgtgtactacgagagcttcaccaactgcaccgagatggaggccaacgtggtgggctgctactggcccaaccccctggcccagggcttcatcaccggcatccacagacagttcttcagcaactgcaccgtggacagagtgcacctggaggacccccccgacgaggtgctgatccccctgatcgtgatccccgtggtgctgaccgtggccatggccggcctggtggtgtggagaagcaagagaaccgacaccctgctgtag

SEQ ID NO: 96533 - DNA, 447 bp, Artificial Sequence; identical to SEQ ID NO: 96532
  Description of Artificial Sequence: Synthetic coding sequence

SEQ ID NO: 96534 - DNA, 456 bp, Artificial Sequence
  Description of Artificial Sequence: Synthetic coding sequence
atggagaccggcgccctgagaagaccccagctgctgcccctgctgctgctgctgtgcggcggctgccccagagccggcggctgcaacgagaccggcatgctggagagactgcccctgtgcggcaaggccttcgccgacatgatgggcaaggtggacgtgtggaagtggtgcaacctgagcgagttcatcgtgtactacgagagcttcaccaactgcaccgagatggaggccaacgtggtgggctgctactggcccaaccccctggcccagggcttcatcaccggcatccacagacagttcttcagcaactgcaccgtggacagagtgcacctggaggacccccccgacgaggtgctgatccccctgatcgtgatccccgtggtgctgaccgtggccatggccggcctggtggtgtggagaagcaagagaaccgacaccctgctgtgcggcaactag

SEQ ID NO: 96535 - DNA, 606 bp, Artificial Sequence
  Description of Artificial Sequence: Synthetic coding sequence
atggtgagctggatcatcagcagactggtggtgctgatcttcggcaccctgtaccccgcctactacagctacaaggccgtgaagagcaaggacatcaaggagtacgtgaagtggatgatgtactggatcatcttcgccctgttcaccaccgccgagaccttcaccgacatcttcctgtgctggttccccttctactacgagctgaagatcgccttcgtggcctggctgctgagcccctacaccaagggcagcagcctgctgtacagaaagttcgtgcaccccaccctgagcagcaaggagaaggagatcgacgactgcctggtgcaggccaaggacagaagctacgacgccctggtgcacttcggcaagagaggcctgaacgtggccgccaccgccgccgtgatggccgccagcaagggccagggcgccctgagcgagagactgagaagcttcagcatgcaggacctgaccaccatcagaggcgacggcgcccccgcccccagcggcccccccccccccggcagcggcagagccagcggcaagcacggccagcccaagatgagcagaagcgccagcgagagcgccagcagcagcggcaccgcctag

SEQ ID NO: 96536 - DNA, 525 bp, Artificial Sequence
  Description of Artificial Sequence: Synthetic coding sequence
atggaccacctgcaggccggcggcgtgaagtggatgatgtactggatcatcttcgccctgttcaccaccgccgagaccttcaccgacatcttcctgtgctggttccccttctactacgagctgaagatcgccttcgtggcctggctgctgagcccctacaccaagggcagcagcctgctgtacagaaagttcgtgcaccccaccctgagcagcaaggagaaggagatcgacgactgcctggtgcaggccaaggacagaagctacgacgccctggtgcacttcggcaagagaggcctgaacgtggccgccaccgccgccgtgatggccgccagcaagggccagggcgccctgagcgagagactgagaagcttcagcatgcaggacctgaccaccatcagaggcgacggcgcccccgcccccagcggcccccccccccccggcagcggcagagccagcggcaagcacggccagcccaagatgagcagaagcgccagcgagagcgccagcagcagcggcaccgcctag

SEQ ID NO: 96537 - DNA, 627 bp, Artificial Sequence
  Description of Artificial Sequence: Synthetic coding sequence
atgcagaaggtgctgagcaacggccagaccgaggaggtgagaagcggcagcagactgatcttcggcaccctgtaccccgcctactacagctacaaggccgtgaagagcaaggacatcaaggagtacgtgaagtggatgatgtactggatcatcttcgccctgttcaccaccgccgagaccttcaccgacatcttcctgtgctggttccccttctactacgagctgaagatcgccttcgtggcctggctgctgagcccctacaccaagggcagcagcctgctgtacagaaagttcgtgcaccccaccctgagcagcaaggagaaggagatcgacgactgcctggtgcaggccaaggacagaagctacgacgccctggtgcacttcggcaagagaggcctgaacgtggccgccaccgccgccgtgatggccgccagcaagggccagggcgccctgagcgagagactgagaagcttcagcatgcaggacctgaccaccatcagaggcgacggcgcccccgcccccagcggcccccccccccccggcagcggcagagccagcggcaagcacggccagcccaagatgagcagaagcgccagcgagagcgccagcagcagcggcaccgcctag

SEQ ID NO: 96538 - DNA, 543 bp, Artificial Sequence
  Description of Artificial Sequence: Synthetic coding sequence
atgagcctgcacccctgcagactgaacaacctgcccaaccaggtgaagtggatgatgtactggatcatcttcgccctgttcaccaccgccgagaccttcaccgacatcttcctgtgctggttccccttctactacgagctgaagatcgccttcgtggcctggctgctgagcccctacaccaagggcagcagcctgctgtacagaaagttcgtgcaccccaccctgagcagcaaggagaaggagatcgacgactgcctggtgcaggccaaggacagaagctacgacgccctggtgcacttcggcaagagaggcctgaacgtggccgccaccgccgccgtgatggccgccagcaagggccagggcgccctgagcgagagactgagaagcttcagcatgcaggacctgaccaccatcagaggcgacggcgcccccgcccccagcggcccccccccccccggcagcggcagagccagcggcaagcacggccagcccaagatgagcagaagcgccagcgagagcgccagcagcagcggcaccgcctag

SEQ ID NO: 96539 - DNA, 432 bp, Artificial Sequence
  Description of Artificial Sequence: Synthetic coding sequence
atggtgagctggatcatcagcagactggtggtgctgatcttcggcaccctgtaccccgcctactacagctacaaggccgtgaagagcaaggacatcaaggagtacgtgaagtggatgatgtactggatcatcttcgccctgttcaccaccgccgagaccttcaccgacatcttcctgtgctgggacagagtgccctacagaagagactgcggcgccagcgcctgcagaaccagcccccccagcggcgagaccgcccccctgctgcccagagccccccaccacagaggcctgggcggccccgccgccaacaccgccagcctgagatgccccggcgtgctgctgagagccctggccgcccaggccccccccagaatcctgagaagcagattcagaaagaagagcaccagcagcagcgccaccgagaccacctag

SEQ ID NO: 96540 - DNA, 759 bp, Artificial Sequence
  Description of Artificial Sequence: Synthetic coding sequence
atggtgagctggatcatcagcagactggtggtgctgatcttcggcaccctgtaccccgcctacagcagctacaaggccgtgaagaccaagaacgtgaaggagtacgtgaagtggatgatgtactggatcgtgttcgccttcttcaccaccgccgagaccctgaccgacatcgtgctgagctggttccccttctacttcgagctgaagatcgccttcgtgatctggctgctgagcccctacaccaagggcagcagcgtgctgtacagaaagttcgtgcaccccaccctgagcaacaaggagaaggagatcgacgagtacatcacccaggccagagacaagagctacgagaccatgatgagagtgggcaagagaggcctgaacctggccgccaacgccgccgtgaccgccgccgccaagggcgtgctgagcgagaagctgagaagcttcagcatgcaggacctgaccctgatcagagacgaggacgccctgcccctgcagagacccgacggcagactgagacccagccccggcagcctgctggacaccatcgaggacctgggcgacgaccccgccctgagcctgagaagcagcaccaaccccgccgacagcagaaccgaggccagcgaggacgacatgggcgacaaggcccccaagagagccaagcccatcaagaaggcccccaaggccgagcccctggccagcaagaccctgaagaccagacccaagaagaagaccagcggcggcggcgacagcgcctag

SEQ ID NO: 96541 - DNA, 765 bp, Artificial Sequence
  Description of Artificial Sequence: Synthetic coding sequence
atggtgagctggatcatcagcagactggtggtgctgatcttcggcaccctgtaccccgcctacagcagctacaaggccgtgaagaccaagaacgtgaaggagtacgtgaagtggatgatgtactggatcgtgttcgccttcttcaccaccgccgagaccctgaccgacatcgtgctgagctggttccccttctacttcgagctgaagatcgccttcgtgatctggctgctgagcccctacaccaagggcagcagcgtgctgtacagaaagttcgtgcaccccaccctgagcaacaaggagaaggagatcgacgagtacatcacccaggccagagacaagagctacgagaccatgatgagagtgggcaagagaggcctgaacctggccgccaacgccgccgtgaccgccgccgccaagggccagggcgtgctgagcgagaagctgagaagcttcagcatgcaggacctgaccctgatcagagacgaggacgccctgcccctgcagagacccgacggcagactgagacccagccccggcagcctgctggacaccatcgaggacctgggcgacgaccccgccctgagcctgagaagcagcaccaaccccgccgacagcagaaccgaggccagcgaggacgacatgggcgacaaggcccccaagagagccaagcccatcaagaaggcccccaaggccgagcccctggccagcaagaccctgaagaccagacccaagaagaagaccagcggcggcggcgacagcgcctag

SEQ ID NO: 96542 - DNA, 723 bp, Artificial Sequence
  Description of Artificial Sequence: Synthetic coding sequence
atgctgtaccccgcctactacagctacaaggccgtgaagaccaagaacgtgaaggagtacgtgagatggatgatgtactggatcgtgttcgccctgtacaccgtgatcgagaccgtggccgaccagaccgtggcctggttccccctgtactacgagctgaagatcgccttcgtgatctggctgctgagcccctacaccaagggcgccagcctgatctacagaaagttcctgcaccccctgctgagcagcaaggagagagagatcgacgactacatcgtgcaggccaaggagagaggctacgagaccatggtgaacttcggcagacagggcctgaacctggccgccaccgccgccgtgaccgccgccgtgaagagccagggcgccatcaccgagagactgagaagcttcagcatgcacgacctgaccaccatccagggcgacgagcccgtgggccagagaccctaccagcccctgcccgaggccaagaagaagagcaagcccgcccccagcgagagcgccggctacggcatccccctgaaggacggcgacgagaagaccgacgaggaggccgagggcccctacagcgacaacgagatgctgacccacaagggcctgagaagaagccagagcatgaagagcgtgaagaccaccaagggcagaaaggaggtgagatacggcagcctgaagtacaaggtgaagaagagaccccaggtgtacttctag

SEQ ID NO: 96543 - DNA, 768 bp, Artificial Sequence
  Description of Artificial Sequence: Synthetic coding sequence
atggtgagctggatgatcagcagagccgtggtgctggtgttcggcatgctgtaccccgcctactacagctacaaggccgtgaagaccaagaacgtgaaggagtacgtgagatggatgatgtactggatcgtgttcgccctgtacaccgtgatcgagaccgtggccgaccagaccgtggcctggttccccctgtactacgagctgaagatcgccttcgtgatctggctgctgagcccctacaccaagggcgccagcctgatctacagaaagttcctgcaccccctgctgagcagcaaggagagagagatcgacgactacatcgtgcaggccaaggagagaggctacgagaccatggtgaacttcggcagacagggcctgaacctggccgccaccgccgccgtgaccgccgccgtgaagagccagggcgccatcaccgagagactgagaagcttcagcatgcacgacctgaccaccatccagggcgacgagcccgtgggccagagaccctaccagcccctgcccgaggccaagaagaagagcaagcccgcccccagcgagagcgccggctacggcatccccctgaaggacggcgacgagaagaccgacgaggaggccgagggcccctacagcgacaacgagatgctgacccacaagggcctgagaagaagccagagcatgaagagcgtgaagaccaccaagggcagaaaggaggtgagatacggcagcctgaagtacaaggtgaagaagagaccccaggtgtacttctag

SEQ ID NO: 96544 - DNA, 774 bp, Artificial Sequence
  Description of Artificial Sequence: Synthetic coding sequence
ctgatgatgtggctgctggtggagagagccctgatccagctggtgttcggcatgctgtaccccgcctactacagctacaaggccgtgaagaccaagaacgtgaaggagtacgtgagatggatgatgtactggatcgtgttcgccctgtacaccgtgatcgagaccgtggccgaccagaccgtggcctggttccccctgtactacgagctgaagatcgccttcgtgatctggctgctgagcccctacaccaagggcgccagcctgatctacagaaagttcctgcaccccctgctgagcagcaaggagagagagatcgacgactacatcgtgcaggccaaggagagaggctacgagaccatggtgaacttcggcagacagggcctgaacctggccgccaccgccgccgtgaccgccgccgtgaagagccagggcgccatcaccgagagactgagaagcttcagcatgcacgacctgaccaccatccagggcgacgagcccgtgggccagagaccctaccagcccctgcccgaggccaagaagaagagcaagcccgcccccagcgagagcgccggctacggcatccccctgaaggacggcgacgagaagaccgacgaggaggccgagggcccctacagcgacaacgagatgctgacccacaagggcctgagaagaagccagagcatgaagagcgtgaagaccaccaagggcagaaaggaggtgagatacggcagcctgaagtacaaggtgaagaagagaccccaggtgtacttctag

SEQ ID NO: 96545 - DNA, 774 bp, Artificial Sequence
  Description of Artificial Sequence: Synthetic coding sequence
atggtgagctggatgatctgcagactggtggtgctggtgttcggcatgctgtgccccgcctacgccagctacaaggccgtgaagaccaagaacatcagagagtacgtgagatggatgatgtactggatcgtgttcgccctgttcatggccgccgagatcgtgaccgacatcttcatcagctggttccccttctactacgagatcaagatggccttcgtgctgtggctgctgagcccctacaccaagggcgccagcctgctgtacagaaagttcgtgcaccccagcctgagcagacacgagaaggagatcgacgcctacatcgtgcaggccaaggagagaagctacgagaccgtgctgagcttcggcaagagaggcctgaacatcgccgccagcgccgccgtgcaggccgccaccaagagccagggcgccctggccggcagactgagaagcttcagcatgcaggacctgagaagcatcagcgacgcccccgcccccgcctaccacgaccccctgtacctggaggaccaggtgagccacagaagaccccccatcggctacagagccggcggcctgcaggacagcgacaccgaggacgagtgctggagcgacaccgaggccgtgcccagagcccccgccagacccagagagaagcccctgatcagaagccagagcctgagagtggtgaagagaaagccccccgtgagagagggcaccagcagaagcctgaaggtgagaaccagaaagaagaccgtgcccagcgacgtggacagctag

SEQ ID NO: 96546 - DNA, 522 bp, Artificial Sequence
  Description of Artificial Sequence: Synthetic coding sequence
atggtgagctggatgatctgcagactggtggtgctggtgttcggcatgctgtgccccgcctacgccagctacaaggccgtgaagaccaagaacatcagagagtacgtgagatggatgatgtactggatcgtgttcgccctgttcatggccgccgagatcgtgaccgacatcttcatcagctggttccccttctactacgagatcaagatggccttcgtgctgtggctgctgagcccctacaccaagggcgccagcctgctgtacagaaagttcgtgcaccccagcctgagcagacacgagaaggagatcgacgcctacatcgtgcaggccaaggagagaagctacgagaccgtgctgagcttcggcaagagaggcctgaacatcgccgccagcgccgccgtgcaggccgccaccaagggcaccggccccggcgcctgcagaaccgccacccccagaatgagcgtgggccagatcctgagacagagccccggcagacagcccggccccgagagaagcccctag

SEQ ID NO: 96547 - DNA, 570 bp, Artificial Sequence
  Description of Artificial Sequence: Synthetic coding sequence
atgagcgccgccatgagagagagattcgacagattcctgcacgagaagaactgcatgaccgacctgctggccaagctggaggccaagaccggcgtgaacagaagcttcatcgccctgggcgtgatcggcctggtggccctgtacctggtgttcggctacggcgccagcctgctgtgcaacctgatcggcttcggctaccccgcctacatcagcatcaaggccatcgagagccccaacaaggaggacgacacccagtggctgacctactgggtggtgtacggcgtgttcagcatcgccgagttcttcagcgacatcttcctgagctggttccccttctactacatgctgaagtgcggcttcctgctgtggtgcatggcccccagccccagcaacggcgccgagctgctgtacaagagaatcatcagacccttcttcctgaagcacgagagccagatggacagcgtggtgaaggacctgaaggacaaggccaaggagaccgccgacgccatcaccaaggaggccaagaaggccaccgtgaacctgctgggcgaggagaagaagagcacctag

SEQ ID NO: 96548 - DNA, 396 bp, Artificial Sequence
  Description of Artificial Sequence: Synthetic coding sequence
atgagcgccgccatgagagagagattcgacagattcctgcacgagaagaactgcatgaccgacctgctggccaagctggaggccaagaccggcgtgaacagaagcttcatcgccctgggcgtgatcggcctggtggccctgtacctggtgttcggctacggcgccagcctgctgtgcaacctgatcggcttcggctaccccgcctacatcagcatcaaggccatcgagagccccaacaaggaggacgacacccagtggctgacctactgggtggtgtacggcgtgttcagcatcgccgagttcttcagcgacatcttcctgagctggttccccttctactacatgctgaaggtgtggagcggcctgggcttcctgctgcccagatgcctgctgtag

SEQ ID NO: 96549 - DNA, 1413 bp, Artificial Sequence
  Description of Artificial Sequence: Synthetic coding sequence
atgcacttcagcatccccgagaccgagagcagaagcggcgacagcggcggcagcgcctacgtggcctacaacatccacgtgaacggcgtgctgcactgcagagtgagatacagccagctgctgggcctgcacgagcagctgagaaaggagtacggcgccaacgtgctgcccgccttcccccccaagaagctgttcagcctgacccccgccgaggtggagcagagaagagagcagctggagaagtacatgcaggccgtgagacaggaccccctgctgggcagcagcgagaccttcaacagcttcctgagaagagcccagcaggagacccagcaggtgcccaccgaggaggtgagcctggaggtgctgctgagcaacggccagaaggtgctggtgaacgtgctgaccagcgaccagaccgaggacgtgctggaggccgtggccgccaagctggacctgcccgacgacctgatcggctacttcagcctgttcctggtgagagagaaggaggacggcgccttcagcttcgtgagaaagctgcaggagttcgagctgccctacgtgagcgtgaccagcctgagaagccaggagtacaagatcgtgctgagaaagagctactgggacagcgcctacgacgacgacgtgatggagaacagagtgggcctgaacctgctgtacgcccagaccgtgagcgacatcgagagaggctggatcctggtgaccaaggagcagcacagacagctgaagagcctgcaggagaaggtgagcaagaaggagttcctgagactggcccagaccctgagacactacggctacctgagattcgacgcctgcgtggccgacttccccgagaaggactgccccgtggtggtgagcgccggcaacagcgagctgagcctgcagctgagactgcccggccagcagctgagagagggcagcttcagagtgaccagaatgagatgctggagagtgaccagcagcgtgcccctgcccagcggcagcaccagcagccccggcagaggcagaggcgaggtgagactggagctggccttcgagtacctgatgagcaaggacagactgcagtgggtgaccatcaccagcccccaggccatcatgatgagcatctgcctgcagagcatggtggacgagctgatggtgaagaagagcggcggcagcatcagaaagatgctgagaagaagagtgggcggcaccctgagaagaagcgacagccagcaggccgtgaagagcccccccctgctggagagccccgacgccaccagagagagcatggtgaagctgagcagcaagctgagcgccgtgagcctgagaggcatcggcagccccagcaccgacgccagcgccagcgacgtgcacggcaacttcgccttcgagggcatcggcgacgaggacctgtag

SEQ ID NO: 96550 - DNA, 2814 bp, Artificial Sequence
  Description of Artificial Sequence: Synthetic coding sequence
atgcacagacccagaagaagaggcaccagaccccccctgctggccctgctggccgccctgctgctggccgccagaggcgccgccgcccaggagaccgagctgagcgtgagcgccgagctggtgcccaccagcagctggaacatcagcagcgagctgaacaaggacagctacctgaccctggacgagcccatgaacaacatcaccaccagcctgggccagaccgccgagctgcactgcaaggtgagcggcaaccccccccccaccatcagatggttcaagaacgacgcccccgtggtgcaggagcccagaagactgagcttcagaagcaccatctacggcagcagactgagaatcagaaacctggacaccaccgacaccggctacttccagtgcgtggccaccaacggcaaggaggtggtgagcagcaccggcgtgctgttcgtgaagttcggccccccccccaccgccagccccggctacagcgacgagtacgaggaggacggcttctgccagccctacagaggcatcgcctgcgccagattcatcggcaacagaaccgtgtacatggagagcctgcacatgcagggcgagatcgagaaccagatcaccgccgccttcaccatgatcggcaccagcagccacctgagcgacaagtgcagccagttcgccatccccagcctgtgccactacgccttcccctactgcgacgagaccagcagcgtgcccaagcccagagacctgtgcagagacgagtgcgagatcctggagaacgtgctgtgccagaccgagtacatcttcgccagaagcaaccccatgatcctgatgagactgaagctgcccaactgcgaggacctgccccagcccgagagccccgaggccgccaactgcatcagaatcggcatccccatggccgaccccatcaacaagaaccacaagtgctacaacagcaccggcgtggactacagaggcaccgtgagcgtgaccaagagcggcagacagtgccagccctggaacagccagtacccccacacccacaccttcaccgccctgagattccccgagctgaacggcggccacagctactgcagaaaccccggcaaccagaaggaggccccctggtgcttcaccctggacgagaacttcaagagcgacctgtgcgacatccccgcctgcgacagcaaggacagcaaggagaagaacaagatggagatcctgtacatcctggtgcccagcgtggccatccccctggccatcgccctgctgttcttcttcatctgcgtgtgcagaaacaaccagaagagcagcagcgcccccgtgcagagacagcccaagcacgtgagaggccagaacgtggagatgagcatgctgaacgcctacaagcccaagagcaaggccaaggagctgcccctgagcgccgtgagattcatggaggagctgggcgagtgcgccttcggcaagatctacaagggccacctgtacctgcccggcatggaccacgcccagctggtggccatcaagaccctgaaggactacaacaacccccagcagtggaccgagttccagcaggaggccagcctgatggccgagctgcaccaccccaacatcgtgtgcctgctgggcgccgtgacccaggagcagcccgtgtgcatgctgttcgagtacatcaaccagggcgacctgcacgagttcctgatcatgagaagcccccacagcgacgtgggctgcagcagcgacgaggacggcaccgtgaagagcagcctggaccacggcgacttcctgcacatcgccatccagatcgccgccggcatggagtacctgagcagccacttcttcgtgcacaaggacctggccgccagaaacatcctgatcggcgagcagctgcacgtgaagatcagcgacctgggcctgagcagagagatctacagcgccgactactacagagtgcagagcaagagcctgctgcccatcagatggatgccccccgaggccatcatgtacggcaagttcagcagcgacagcgacatctggagcttcggcgtggtgctgtgggagatcttcagcttcggcctgcagccctactacggcttcagcaaccaggaggtgatcgagatggtgagaaagagacagctgctgccctgcagcgaggactgcccccccagaatgtacagcctgatgaccgagtgctggaacgagatccccagcagaagacccagattcaaggacatccacgtgagactgagaagctgggagggcctgagcagccacaccagcagcaccacccccagcggcggcaacgccaccacccagaccaccagcctgagcgccagccccgtgagcaacctgagcaaccccagataccccaactacatgttccccagccagggcatcaccccccagggccagatcgccggcttcatcggcccccccatcccccagaaccagagattcatccccatcaacggctaccccatcccccccggctacgccgccttccccgccgcccactaccagcccaccggcccccccagagtgatccagcactgccccccccccaagagcagaagccccagcagcgccagcggcagcaccagcaccggccacgtgaccagcctgcccagcagcggcagcaaccaggaggccaacatccccctgctgccccacatgagcatccccaaccaccccggcggcatgggcatcaccgtgttcggcaacaagagccagaagccctacaagatcgacagcaagcaggccagcctgctgggcgacgccaacatccacggccacaccgagagcatgatcagcgccgagctgtag

SEQ ID NO: 96551 - DNA, 1182 bp, Artificial Sequence
  Description of Artificial Sequence: Synthetic coding sequence
atgcacagacccagaagaagaggcaccagaccccccctgctggccctgctggccgccctgctgctggccgccagaggcgccgccgcccaggagaccgagctgagcgtgagcgccgagctggtgcccaccagcagctggaacatcagcagcgagctgaacaaggacagctacctgaccctggacgagcccatgaacaacatcaccaccagcctgggccagaccgccgagctgcactgcaaggtgagcggcaaccccccccccaccatcagatggttcaagaacgacgcccccgtggtgcaggagcccagaagactgagcttcagaagcaccatctacggcagcagactgagaatcagaaacctggacaccaccgacaccggctacttccagtgcgtggccaccaacggcaaggaggtggtgagcagcaccggcgtgctgttcgtgaagttcggccccccccccaccgccagccccggctacagcgacgagtacgaggaggacggcttctgccagccctacagaggcatcgcctgcgccagattcatcggcaacagaaccgtgtacatggagagcctgcacatgcagggcgagatcgagaaccagatcaccgccgccttcaccatgatcggcaccagcagccacctgagcgacaagtgcagccagttcgccatccccagcctgtgccactacgccttcccctactgcgacgagaccagcagcgtgcccaagcccagagacctgtgcagagacgagtgcgagatcctggagaacgtgctgtgccagaccgagtacatcttcgccagaagcaaccccatgatcctgatgagactgaagctgcccaactgcgaggacctgccccagcccgagagccccgaggccgccaactgcatcagaatcggcatccccatggccgaccccatcaacaagaaccacaagtgctacaacagcaccggcgtggactacagaggcaccgtgagcgtgaccaagagcggcagacagtgccagccctggaacagccagtacccccacacccacaccttcaccgccctgagattccccgagctgaacggcggccacagctactgcagaaaccccggcaaccagaaggaggccccctggtgcttcaccctggacgagaacttcaagagcgacctgtgcgacatccccgcctgcggcaagtag

SEQ ID NO: 96552 - DNA, 2823 bp, Artificial Sequence
  Description of Artificial Sequence: Synthetic coding sequence
agagccagaggctgcagcgccagaagaagaggcaccagaccccccctgctggccctgctggccgccctgctgctggccgccagaggcgccgccgcccaggagaccgagctgagcgtgagcgccgagctggtgcccaccagcagctggaacatcagcagcgagctgaacaaggacagctacctgaccctggacgagcccatgaacaacatcaccaccagcctgggccagaccgccgagctgcactgcaaggtgagcggcaaccccccccccaccatcagatggttcaagaacgacgcccccgtggtgcaggagcccagaagactgagcttcagaagcaccatctacggcagcagactgagaatcagaaacctggacaccaccgacaccggctacttccagtgcgtggccaccaacggcaaggaggtggtgagcagcaccggcgtgctgttcgtgaagttcggccccccccccaccgccagccccggctacagcgacgagtacgaggaggacggcttctgccagccctacagaggcatcgcctgcgccagattcatcggcaacagaaccgtgtacatggagagcctgcacatgcagggcgagatcgagaaccagatcaccgccgccttcaccatgatcggcaccagcagccacctgagcgacaagtgcagccagttcgccatccccagcctgtgccactacgccttcccctactgcgacgagaccagcagcgtgcccaagcccagagacctgtgcagagacgagtgcgagatcctggagaacgtgctgtgccagaccgagtacatcttcgccagaagcaaccccatgatcctgatgagactgaagctgcccaactgcgaggacctgccccagcccgagagccccgaggccgccaactgcatcagaatcggcatccccatggccgaccccatcaacaagaaccacaagtgctacaacagcaccggcgtggactacagaggcaccgtgagcgtgaccaagagcggcagacagtgccagccctggaacagccagtacccccacacccacaccttcaccgccctgagattccccgagctgaacggcggccacagctactgcagaaaccccggcaaccagaaggaggccccctggtgcttcaccctggacgagaacttcaagagcgacctgtgcgacatccccgcctgcgacagcaaggacagcaaggagaagaacaagatggagatcctgtacatcctggtgcccagcgtggccatccccctggccatcgccctgctgttcttcttcatctgcgtgtgcagaaacaaccagaagagcagcagcgcccccgtgcagagacagcccaagcacgtgagaggccagaacgtggagatgagcatgctgaacgcctacaagcccaagagcaaggccaaggagctgcccctgagcgccgtgagattcatggaggagctgggcgagtgcgccttcggcaagatctacaagggccacctgtacctgcccggcatggaccacgcccagctggtggccatcaagaccctgaaggactacaacaacccccagcagtggaccgagttccagcaggaggccagcctgatggccgagctgcaccaccccaacatcgtgtgcctgctgggcgccgtgacccaggagcagcccgtgtgcatgctgttcgagtacatcaaccagggcgacctgcacgagttcctgatcatgagaagcccccacagcgacgtgggctgcagcagcgacgaggacggcaccgtgaagagcagcctggaccacggcgacttcctgcacatcgccatccagatcgccgccggcatggagtacctgagcagccacttcttcgtgcacaaggacctggccgccagaaacatcctgatcggcgagcagctgcacgtgaagatcagcgacctgggcctgagcagagagatctacagcgccgactactacagagtgcagagcaagagcctgctgcccatcagatggatgccccccgaggccatcatgtacggcaagttcagcagcgacagcgacatctggagcttcggcgtggtgctgtgggagatcttcagcttcggcctgcagccctactacggcttcagcaaccaggaggtgatcgagatggtgagaaagagacagctgctgccctgcagcgaggactgcccccccagaatgtacagcctgatgaccgagtgctggaacgagatccccagcagaagacccagattcaaggacatccacgtgagactgagaagctgggagggcctgagcagccacaccagcagcaccacccccagcggcggcaacgccaccacccagaccaccagcctgagcgccagccccgtgagcaacctgagcaaccccagataccccaactacatgttccccagccagggcatcaccccccagggccagatcgccggcttcatcggcccccccatcccccagaaccagagattcatccccatcaacggctaccccatcccccccggctacgccgccttccccgccgcccactaccagcccaccggcccccccagagtgatccagcactgccccccccccaagagcagaagccccagcagcgccagcggcagcaccagcaccggccacgtgaccagcctgcccagcagcggcagcaaccaggaggccaacatccccctgctgccccacatgagcatccccaaccaccccggcggcatgggcatcaccgtgttcggcaacaagagccagaagccctacaagatcgacagcaagcaggccagcctgctgggcgacgccaacatccacggccacaccgagagcatgatcagcgccgagctgtag

SEQ ID NO: 96553 - DNA, 1167 bp, Artificial Sequence
  Description of Artificial Sequence: Synthetic coding sequence
atgctgttcgagtacatcaaccagggcgacctgcacgagttcctgatcatgagaagcccccacagcgacgtgggctgcagcagcgacgaggacggcaccgtgaagagcagcctggaccacggcgacttcctgcacatcgccatccagatcgccgccggcatggagtacctgagcagccacttcttcgtgcacaaggacctggccgccagaaacatcctgatcggcgagcagctgcacgtgaagatcagcgacctgggcctgagcagagagatctacagcgccgactactacagagtgcagagcaagagcctgctgcccatcagatggatgccccccgaggccatcatgtacggcaagttcagcagcgacagcgacatctggagcttcggcgtggtgctgtgggagatcttcagcttcggcctgcagccctactacggcttcagcaaccaggaggtgatcgagatggtgagaaagagacagctgctgccctgcagcgaggactgcccccccagaatgtacagcctgatgaccgagtgctggaacgagatccccagcagaagacccagattcaaggacatccacgtgagactgagaagctgggagggcctgagcagccacaccagcagcaccacccccagcggcggcaacgccaccacccagaccaccagcctgagcgccagccccgtgagcaacctgagcaaccccagataccccaactacatgttccccagccagggcatcaccccccagggccagatcgccggcttcatcggcccccccatcccccagaaccagagattcatccccatcaacggctaccccatcccccccggctacgccgccttccccgccgcccactaccagcccaccggcccccccagagtgatccagcactgccccccccccaagagcagaagccccagcagcgccagcggcagcaccagcaccggccacgtgaccagcctgcccagcagcggcagcaaccaggaggccaacatccccctgctgccccacatgagcatccccaaccaccccggcggcatgggcatcaccgtgttcggcaacaagagccagaagccctacaagatcgacagcaagcaggccagcctgctgggcgacgccaacatccacggccacaccgagagcatgatcagcgccgagctgtag

SEQ ID NO: 96554 - DNA, 2832 bp, Artificial Sequence
  Description of Artificial Sequence: Synthetic coding sequence
atggccagaggcagcgccctgcccagaagacccctgctgtgcatccccgccgtgtgggccgccgccgccctgctgctgagcgtgagcagaaccagcggcgaggtggaggtgctggaccccaacgaccccctgggccccctggacggccaggacggccccatccccaccctgaagggctacttcctgaacttcctggagcccgtgaacaacatcaccatcgtgcagggccagaccgccatcctgcactgcaaggtggccggcaaccccccccccaacgtgagatggctgaagaacgacgcccccgtggtgcaggagcccagaagaatcatcatcagaaagaccgagtacggcagcagactgagaatccaggacctggacaccaccgacaccggctactaccagtgcgtggccaccaacggcatgaagaccatcaccgccaccggcgtgctgttcgtgagactgggccccacccacagccccaaccacaacttccaggacgactaccacgaggacggcttctgccagccctacagaggcatcgcctgcgccagattcatcggcaacagaaccatctacgtggacagcctgcagatgcagggcgagatcgagaacagaatcaccgccgccttcaccatgatcggcaccagcacccacctgagcgaccagtgcagccagttcgccatccccagcttctgccacttcgtgttccccctgtgcgacgccagaagcagaacccccaagcccagagagctgtgcagagacgagtgcgaggtgctggagagcgacctgtgcagacaggagtacaccatcgccagaagcaaccccctgatcctgatgagactgcagctgcccaagtgcgaggccctgcccatgcccgagagccccgacgccgccaactgcatgagaatcggcatccccgccgagagactgggcagataccaccagtgctacaacggcagcggcatggactacagaggcaccgccagcaccaccaagagcggccaccagtgccagccctgggccctgcagcacccccacagccaccacctgagcagcaccgacttccccgagctgggcggcggccacgcctactgcagaaaccccggcggccagatggagggcccctggtgcttcacccagaacaagaacgtgagaatggagctgtgcgacgtgcccagctgcagccccagagacagcagcaagatgggcatcctgtacatcctggtgcccagcatcgccatccccctggtgatcgcctgcctgttcttcctggtgtgcatgtgcagaaacaagcagaaggccagcgccagcaccccccagagaagacagctgatggccagccccagccaggacatggagatgcccctgatcaaccagcacaagcaggccaagctgaaggagatcagcctgagcgccgtgagattcatggaggagctgggcgaggacagattcggcaaggtgtacaagggccacctgttcggccccgcccccggcgagcagacccaggccgtggccatcaagaccctgaaggacaaggccgagggccccctgagagaggagttcagacacgaggccatgctgagagccagactgcagcaccccaacgtggtgtgcctgctgggcgtggtgaccaaggaccagcccctgagcatgatcttcagctactgcagccacggcgacctgcacgagttcctggtgatgagaagcccccacagcgacgtgggcagcaccgacgacgacagaaccgtgaagagcgccctggagccccccgacttcgtgcacctggtggcccagatcgccgccggcatggagtacctgagcagccaccacgtggtgcacaaggacctggccaccagaaacgtgctggtgtacgacaagctgaacgtgaagatcagcgacctgggcctgttcagagaggtgtacgccgccgactactacaagctgctgggcaacagcctgctgcccatcagatggatggcccccgaggccatcatgtacggcaagttcagcatcgacagcgacatctggagctacggcgtggtgctgtgggaggtgttcagctacggcctgcagccctactgcggctacagcaaccaggacgtggtggagatgatcagaaacagacaggtgctgccctgccccgacgactgccccgcctgggtgtacgccctgatgatcgagtgctggaacgagttccccagcagaagacccagattcaaggacatccacagcagactgagagcctggggcaacctgagcaactacaacagcagcgcccagaccagcggcgccagcaacaccacccagaccagcagcctgagcaccagccccgtgagcaacgtgagcaacgccagatacgtgggccccaagcagaaggccccccccttcccccagccccagttcatccccatgaagggccagatcagacccatggtgccccccccccagctgtacgtgcccgtgaacggctaccagcccgtgcccgcctacggcgcctacctgcccaacttctaccccgtgcagatccccatgcagatggccccccagcaggtgcccccccagatggtgcccaagcccagcagccaccacagcggcagcggcagcaccagcaccggctacgtgaccaccgcccccagcaacaccagcatggccgacagagccgccctgctgagcgagggcgccgacgacacccagaacgcccccgaggacggcgcccagagcaccgtgcaggaggccgaggaggaggaggagggcagcgtgcccgagaccgagctgctgggcgactgcgacaccctgcaggtggacgaggcccaggtgcagctggaggcctag

SEQ ID NO: 96555 - DNA, 1239 bp, Artificial Sequence
  Description of Artificial Sequence: Synthetic coding sequence
atgggccaggaccagaccaagcagcagatcgagaagggcctgcagctgtaccagagcaaccagaccgagaaggccctgcaggtgtggaccaaggtgctggagaagagcagcgacctgatgggcagattcagagtgctgggctgcctggtgaccgcccacagcgagatgggcagatacaaggagatgctgaagttcgccgtggtgcagatcgacaccgccagagagctggaggacgccgacttcctgctggagagctacctgaacctggccagaagcaacgagaagctgtgcgagttccacaagaccatcagctactgcaagacctgcctgggcctgcccggcaccagagccggcgcccagctgggcggccaggtgagcctgagcatgggcaacgccttcctgggcctgagcgtgttccagaaggccctggagagcttcgagaaggccctgagatacgcccacaacaacgacgacgccatgctggagtgcagagtgtgctgcagcctgggcagcttctacgcccaggtgaaggactacgagaaggccctgttcttcccctgcaaggccgccgagctggtgaacaactacggcaagggctggagcctgaagtacagagccatgagccagtaccacatggccgtggcctacagactgctgggcagactgggcagcgccatggagtgctgcgaggagagcatgaagatcgccctgcagcacggcgacagacccctgcaggccctgtgcctgctgtgcttcgccgacatccacagaagcagaggcgacctggagaccgccttccccagatacgacagcgccatgagcatcatgaccgagatcggcaacagactgggccaggtgcaggccctgctgggcgtggccaagtgctgggtggccagaaaggccctggacaaggccctggacgccatcgagagagcccaggacctggccgaggaggtgggcaacaagctgagccagctgaagctgcactgcctgagcgagagcatctacagaagcaagggcctgcagagagagctgagagcccacgtggtgagattccacgagtgcgtggaggagaccgagctgtactgcggcctgtgcggcgagagcatcggcgagaagaacagcagactgcaggccctgccctgcagccacatcttccacctgagatgcctgcagaacaacggcaccagaagctgccccaactgcagaagaagcagcatgaagcccggcttcgtgtag

SEQ ID NO: 96556 - DNA, 1062 bp, Artificial Sequence
  Description of Artificial Sequence: Synthetic coding sequence
atgggccaggaccagaccaagcagcagatcgagaagggcctgcagctgtaccagagcaaccagaccgagaaggccctgcaggtgtggaccaaggtgctggagaagagcagcgacctgatgggcagattcagagtgctgggctgcctggtgaccgcccacagcgagatgggcagatacaaggagatgctgaagttcgccgtggtgcagatcgacaccgccagagagctggaggacgccgacttcctgctggagagctacctgaacctggccagaagcaacgagaagctgtgcgagttccacaagaccatcagctactgcaagacctgcctgggcctgcccggcaccagagccggcgcccagctgggcggccaggtgagcctgagcatgggcaacgccttcctgggcctgagcgtgttccagaaggccctggagagcttcgagaaggccctgagatacgcccacaacaacgacgacgccatgctggagtgcagagtgtgctgcagcctgggcagcttctacgcccaggtgaaggactacgagaaggccctgttcttcccctgcaaggccgccgagctggtgaacaactacggcaagggctggagcctgaagtacagagccatgagccagtaccacatggccgtggcctacagactgctgggcagactgggcagcgccatggagtgctgcgaggagagcatgaagatcgccctgcagcacggcgacagacccctgcaggccctgtgcctgctgtgcttcgccgacatccacagaagcagaggcgacctggagctgagccagctgaagctgcactgcctgagcgagagcatctacagaagcaagggcctgcagagagagctgagagcccacgtggtgagattccacgagtgcgtggaggagaccgagctgtactgcggcctgtgcggcgagagcatcggcgagaagaacagcagactgcaggccctgccctgcagccacatcttccacctgagatgcctgcagaacaacggcaccagaagctgccccaactgcagaagaagcagcatgaagcccggcttcgtgtag

SEQ ID NO: 96557 - DNA, 2010 bp, Artificial Sequence
  Description of Artificial Sequence: Synthetic coding sequence
atgggcaccgccctggtgtaccacgaggacatgaccgccaccagactgctgtgggacgaccccgagtgcgagatcgagagacccgagagactgaccgccgccctggacagactgagacagagaggcctggagcagagatgcctgagactgagcgccagagaggccagcgaggaggagctgggcctggtgcacagccccgagtacgtgagcctggtgagagagacccaggtgctgggcaaggaggagctgcaggccctgagcggccagttcgacgccatctacttccaccccagcaccttccactgcgccagactggccgccggcgccggcctgcagctggtggacgccgtgctgaccggcgccgtgcagaacggcctggccctggtgagaccccccggccaccacggccagagagccgccgccaacggcttctgcgtgttcaacaacgtggccatcgccgccgcccacgccaagcagaagcacggcctgcacagaatcctggtggtggactgggacgtgcaccacggccagggcatccagtacctgttcgaggacgaccccagcgtgctgtacttcagctggcacagatacgagcacggcagattctggcccttcctgagagagagcgacgccgacgccgtgggcagaggccagggcctgggcttcaccgtgaacctgccctggaaccaggtgggcatgggcaacgccgactacgtggccgccttcctgcacctgctgctgcccctggccttcgagttcgaccccgagctggtgctggtgagcgccggcttcgacagcgccatcggcgaccccgagggccagatgcaggccacccccgagtgcttcgcccacctgacccagctgctgcaggtgctggccggcggcagagtgtgcgccgtgctggagggcggctaccacctggagagcctggccgagagcgtgtgcatgaccgtgcagaccctgctgggcgaccccgccccccccctgagcggccccatggccccctgccagagcgccctggagagcatccagagcgccagagccgcccaggccccccactggaagagcctgcagcagcaggacgtgaccgccgtgcccatgagccccagcagccacagccccgagggcagacccccccccctgctgcccggcggccccgtgtgcaaggccgccgccagcgcccccagcagcctgctggaccagccctgcctgtgccccgcccccagcgtgagaaccgccgtggccctgaccacccccgacatcaccctggtgctgccccccgacgtgatccagcaggaggccagcgccctgagagaggagaccgaggcctgggccagaccccacgagagcctggccagagaggaggccctgaccgccctgggcaagctgctgtacctgctggacggcatgctggacggccaggtgaacagcggcatcgccgccacccccgccagcgccgccgccgccaccctggacgtggccgtgagaagaggcctgagccacggcgcccagagactgctgtgcgtggccctgggccagctggacagaccccccgacctggcccacgacggcagaagcctgtggctgaacatcagaggcaaggaggccgccgccctgagcatgttccacgtgagcacccccctgcccgtgatgaccggcggcttcctgagctgcatcctgggcctggtgctgcccctggcctacggcttccagcccgacctggtgctggtggccctgggccccggccacggcctgcagggcccccacgccgccctgctggccgccatgctgagaggcctggccggcggcagagtgctggccctgctggaggagaacagcaccccccagctggccggcatcctggccagagtgctgaacggcgaggccccccccagcctgggccccagcagcgtggccagccccgaggacgtgcaggccctgatgtacctgagaggccagctggagccccagtggaagatgctgcagtgccacccccacctggtggcctag

SEQ ID NO: 96558 - DNA, 1206 bp, Artificial Sequence
  Description of Artificial Sequence: Synthetic coding sequence
atgcagagatgctggcagggcgaccccagagtgagacccaccttccaggagatcaccagcgagaccgaggacctgtgcgagaagcccgacgacgaggtgaaggagaccgcccacgacctggacgtgaagagcccccccgagcccagaagcgaggtggtgcccgccagactgaagagagccagcgcccccaccttcgacaacgactacagcctgagcgagctgctgagccagctggacagcggcgtgagccaggccgtggagggccccgaggagctgagcagaagcagcagcgagagcaagctgcccagcagcggcagcggcaagagactgagcggcgtgagcagcgtggacagcgccttcagcagcagaggcagcctgagcctgagcttcgagagagagcccagcaccagcgacctgggcaccaccgacgtgcagaagaagaagctggtggacgccatcgtgagcggcgacaccagcaagctgatgaagatcctgcagccccaggacgtggacctggccctggacagcggcgccagcctgctgcacctggccgtggaggccggccaggaggagtgcgccaagtggctgctgctgaacaacgccaaccccaacctgagcaacagaagaggcagcacccccctgcacatggccgtggagagaagagtgagaggcgtggtggagctgctgctggccagaaagatcagcgtgaacgccaaggacgaggaccagtggaccgccctgcacttcgccgcccagaacggcgacgagagcagcaccagactgctgctggagaagaacgccagcgtgaacgaggtggacttcgagggcagaacccccatgcacgtggcctgccagcacggccaggagaacatcgtgagaatcctgctgagaagaggcgtggacgtgagcctgcagggcaaggacgcctggcactgcaccaccctggccggcccccccgcccacagacaggccgccggccaggccgccggcggcgagtgcgagagacccgacgccggctgggaggacgccatcgcccccggcagaaccgccagagccctgcccagaggcccccacccccacagacccgtgctgagaagacagagactgcagcccgccggcaccgacacccccgccagacccagaagaagaggcaccagagccctgcccggctgcagctgcatcggcgccctggccagaagaccctag

SEQ ID NO: 96559 - DNA, 2355 bp, Artificial Sequence
  Description of Artificial Sequence: Synthetic coding sequence
atggagggcgacggcggcaccccctgggccctggccctgctgagaaccttcgacgccggcgagttcaccggctgggagaaggtgggcagcggcggcttcggccaggtgtacaaggtgagacacgtgcactggaagacctggctggccatcaagtgcagccccagcctgcacgtggacgacagagagagaatggagctgctggaggaggccaagaagatggagatggccaagttcagatacatcctgcccgtgtacggcatctgcagagagcccgtgggcctggtgatggagtacatggagaccggcagcctggagaagctgctggccagcgagcccctgccctgggacctgagattcagaatcatccacgagaccgccgtgggcatgaacttcctgcactgcatggccccccccctgctgcacctggacctgaagcccgccaacatcctgctggacgcccactaccacgtgaagatcagcgacttcggcctggccaagtgcaacggcctgagccacagccacgacctgagcatggacggcctgttcggcaccatcgcctacctgccccccgagagaatcagagagaagagcagactgttcgacaccaagcacgacgtgtacagcttcgccatcgtgatctggggcgtgctgacccagaagaagcccttcgccgacgagaagaacatcctgcacatcatggtgaaggtggtgaagggccacagacccgagctgccccccgtgtgcagagccagacccagagcctgcagccacctgatcagactgatgcagagatgctggcagggcgaccccagagtgagacccaccttccaggagatcaccagcgagaccgaggacctgtgcgagaagcccgacgacgaggtgaaggagaccgcccacgacctggacgtgaagagcccccccgagcccagaagcgaggtggtgcccgccagactgaagagagccagcgcccccaccttcgacaacgactacagcctgagcgagctgctgagccagctggacagcggcgtgagccaggccgtggagggccccgaggagctgagcagaagcagcagcgagagcaagctgcccagcagcggcagcggcaagagactgagcggcgtgagcagcgtggacagcgccttcagcagcagaggcagcctgagcctgagcttcgagagagagcccagcaccagcgacctgggcaccaccgacgtgcagaagaagaagctggtggacgccatcgtgagcggcgacaccagcaagctgatgaagatcctgcagccccaggacgtggacctggccctggacagcggcgccagcctgctgcacctggccgtggaggccggccaggaggagtgcgccaagtggctgctgctgaacaacgccaaccccaacctgagcaacagaagaggcagcacccccctgcacatggccgtggagagaagagtgagaggcgtggtggagctgctgctggccagaaagatcagcgtgaacgccaaggacgaggaccagtggaccgccctgcacttcgccgcccagaacggcgacgagagcagcaccagactgctgctggagaagaacgccagcgtgaacgaggtggacttcgagggcagaacccccatgcacgtggcctgccagcacggccaggagaacatcgtgagaatcctgctgagaagaggcgtggacgtgagcctgcagggcaaggacgcctggctgcccctgcactacgccgcctggcagggccacctgcccatcgtgaagctgctggccaagcagcccggcgtgagcgtgaacgcccagaccctggacggcagaacccccctgcacctggccgcccagagaggccactacagagtggccagaatcctgatcgacctgtgcagcgacgtgaacgtgtgcagcctgctggcccagacccccctgcacgtggccgccgagaccggccacaccagcaccgccagactgctgctgcacagaggcgccggcaaggaggccatgaccagcgacggctacaccgccctgcacctggccgccagaaacggccacctggccaccgtgaagctgctggtggaggagaaggccgacgtgctggccagaggccccctgaaccagaccgccctgcacctggccgccgcccacggccacagcgaggtggtggaggagctggtgagcgccgacgtgatcgacctgttcgacgagcagggcctgagcgccctgcacctggccgcccagggcagacacgcccagaccgtggagaccctgctgagacacggcgcccacatcaacctgcagagcctgaagttccagggcggccacggccccgccgccaccctgctgagaagaagcaagacctag

SEQ ID NO: 96560 - DNA, 2499 bp, Artificial Sequence
  Description of Artificial Sequence: Synthetic coding sequence
atggagggcgacggcggcaccccctgggccctggccctgctgagaaccttcgacgccggcgagttcaccggctgggagaaggtgggcagcggcggcttcggccaggtgtacaaggtgagacacgtgcactggaagacctggctggccatcaagtgcagccccagcctgcacgtggacgacagagagagaatggagctgctggaggaggccaagaagatggagatggccaagttcagatacatcctgcccgtgtacggcatctgcagagagcccgtgggcctggtgatggagtacatggagaccggcagcctggagaagctgctggccagcgagcccctgccctgggacctgagattcagaatcatccacgagaccgccgtgggcatgaacttcctgcactgcatggccccccccctgctgcacctggacctgaagcccgccaacatcctgctggacgcccactaccacgtgaagatcagcgacttcggcctggccaagtgcaacggcctgagccacagccacgacctgagcatggacggcctgttcggcaccatcgcctacctgccccccgagagaatcagagagaagagcagactgttcgacaccaagcacgacgtgtacagcttcgccatcgtgatctggggcgtgctgacccagaagaagcccttcgccgacgagaagaacatcctgcacatcatggtgaaggtggtgaagggccacagacccgagctgccccccgtgtgcagagccagacccagagcctgcagccacctgatcagactgatgcagagatgctggcagggcgaccccagagtgagacccaccttccagggcaacggcctgaacggcgagctgatcagacaggtgctggccgccctgctgcccgtgaccggcagatggagaagccccggcgagggcttcagactggagagcgaggtgatcatcagagtgacctgccccctgagcagcccccaggagatcaccagcgagaccgaggacctgtgcgagaagcccgacgacgaggtgaaggagaccgcccacgacctggacgtgaagagcccccccgagcccagaagcgaggtggtgcccgccagactgaagagagccagcgcccccaccttcgacaacgactacagcctgagcgagctgctgagccagctggacagcggcgtgagccaggccgtggagggccccgaggagctgagcagaagcagcagcgagagcaagctgcccagcagcggcagcggcaagagactgagcggcgtgagcagcgtggacagcgccttcagcagcagaggcagcctgagcctgagcttcgagagagagcccagcaccagcgacctgggcaccaccgacgtgcagaagaagaagctggtggacgccatcgtgagcggcgacaccagcaagctgatgaagatcctgcagccccaggacgtggacctggccctggacagcggcgccagcctgctgcacctggccgtggaggccggccaggaggagtgcgccaagtggctgctgctgaacaacgccaaccccaacctgagcaacagaagaggcagcacccccctgcacatggccgtggagagaagagtgagaggcgtggtggagctgctgctggccagaaagatcagcgtgaacgccaaggacgaggaccagtggaccgccctgcacttcgccgcccagaacggcgacgagagcagcaccagactgctgctggagaagaacgccagcgtgaacgaggtggacttcgagggcagaacccccatgcacgtggcctgccagcacggccaggagaacatcgtgagaatcctgctgagaagaggcgtggacgtgagcctgcagggcaaggacgcctggctgcccctgcactacgccgcctggcagggccacctgcccatcgtgaagctgctggccaagcagcccggcgtgagcgtgaacgcccagaccctggacggcagaacccccctgcacctggccgcccagagaggccactacagagtggccagaatcctgatcgacctgtgcagcgacgtgaacgtgtgcagcctgctggcccagacccccctgcacgtggccgccgagaccggccacaccagcaccgccagactgctgctgcacagaggcgccggcaaggaggccatgaccagcgacggctacaccgccctgcacctggccgccagaaacggccacctggccaccgtgaagctgctggtggaggagaaggccgacgtgctggccagaggccccctgaaccagaccgccctgcacctggccgccgcccacggccacagcgaggtggtggaggagctggtgagcgccgacgtgatcgacctgttcgacgagcagggcctgagcgccctgcacctggccgcccagggcagacacgcccagaccgtggagaccctgctgagacacggcgcccacatcaacctgcagagcctgaagttccagggcggccacggccccgccgccaccctgctgagaagaagcaagacctag

SEQ ID NO: 96561 - DNA, 2166 bp, Artificial Sequence
  Description of Artificial Sequence: Synthetic coding sequence
atggagctgctggaggaggccaagaagatggagatggccaagttcagatacatcctgcccgtgtacggcatctgcagagagcccgtgggcctggtgatggagtacatggagaccggcagcctggagaagctgctggccagcgagcccctgccctgggacctgagattcagaatcatccacgagaccgccgtgggcatgaacttcctgcactgcatggccccccccctgctgcacctggacctgaagcccgccaacatcctgctggacgcccactaccacgtgaagatcagcgacttcggcctggccaagtgcaacggcctgagccacagccacgacctgagcatggacggcctgttcggcaccatcgcctacctgccccccgagagaatcagagagaagagcagactgttcgacaccaagcacgacgtgtacagcttcgccatcgtgatctggggcgtgctgacccagaagaagcccttcgccgacgagaagaacatcctgcacatcatggtgaaggtggtgaagggccacagacccgagctgccccccgtgtgcagagccagacccagagcctgcagccacctgatcagactgatgcagagatgctggcagggcgaccccagagtgagacccaccttccaggagatcaccagcgagaccgaggacctgtgcgagaagcccgacgacgaggtgaaggagaccgcccacgacctggacgtgaagagcccccccgagcccagaagcgaggtggtgcccgccagactgaagagagccagcgcccccaccttcgacaacgactacagcctgagcgagctgctgagccagctggacagcggcgtgagccaggccgtggagggccccgaggagctgagcagaagcagcagcgagagcaagctgcccagcagcggcagcggcaagagactgagcggcgtgagcagcgtggacagcgccttcagcagcagaggcagcctgagcctgagcttcgagagagagcccagcaccagcgacctgggcaccaccgacgtgcagaagaagaagctggtggacgccatcgtgagcggcgacaccagcaagctgatgaagatcctgcagccccaggacgtggacctggccctggacagcggcgccagcctgctgcacctggccgtggaggccggccaggaggagtgcgccaagtggctgctgctgaacaacgccaaccccaacctgagcaacagaagaggcagcacccccctgcacatggccgtggagagaagagtgagaggcgtggtggagctgctgctggccagaaagatcagcgtgaacgccaaggacgaggaccagtggaccgccctgcacttcgccgcccagaacggcgacgagagcagcaccagactgctgctggagaagaacgccagcgtgaacgaggtggacttcgagggcagaacccccatgcacgtggcctgccagcacggccaggagaacatcgtgagaatcctgctgagaagaggcgtggacgtgagcctgcagggcaaggacgcctggctgcccctgcactacgccgcctggcagggccacctgcccatcgtgaagctgctggccaagcagcccggcgtgagcgtgaacgcccagaccctggacggcagaacccccctgcacctggccgcccagagaggccactacagagtggccagaatcctgatcgacctgtgcagcgacgtgaacgtgtgcagcctgctggcccagacccccctgcacgtggccgccgagaccggccacaccagcaccgccagactgctgctgcacagaggcgccggcaaggaggccatgaccagcgacggctacaccgccctgcacctggccgccagaaacggccacctggccaccgtgaagctgctggtggaggagaaggccgacgtgctggccagaggccccctgaaccagaccgccctgcacctggccgccgcccacggccacagcgaggtggtggaggagctggtgagcgccgacgtgatcgacctgttcgacgagcagggcctgagcgccctgcacctggccgcccagggcagacacgcccagaccgtggagaccctgctgagacacggcgcccacatcaacctgcagagcctgaagttccagggcggccacggccccgccgccaccctgctgagaagaagcaagacctag

SEQ ID NO: 96562 - DNA, 2166 bp, Artificial Sequence; identical to SEQ ID NO: 96561
  Description of Artificial Sequence: Synthetic coding sequence

SEQ ID NO: 96563 - DNA, 3132 bp, Artificial Sequence
  Description of Artificial Sequence: Synthetic coding sequence
atggccgccagcttcccccccaccctgggcctgagcagcgcccccgacgagatccagcacccccacatcaagttcagcgagtggaagttcaagctgttcagagtgagaagcttcgagaagacccccgaggaggcccagaaggagaagaaggacagcttcgagggcaagcccagcctggagcagagccccgccgtgctggacaaggccgacggccagaagcccgtgcccacccagcccctgctgaaggcccaccccaagttcagcaagaagttccacgacaacgagaaggccagaggcaaggccatccaccaggccaacctgagacacctgtgcagaatctgcggcaacagcttcagagccgacgagcacaacagaagataccccgtgcacggccccgtggacggcaagaccctgggcctgctgagaaagaaggagaagagagccaccagctggcccgacctgatcgccaaggtgttcagaatcgacgtgaaggccgacgtggacagcatccaccccaccgagttctgccacaactgctggagcatcatgcacagaaagttcagcagcgccccctgcgaggtgtacttccccagaaacgtgaccatggagtggcacccccacacccccagctgcgacatctgcaacaccgccagaagaggcctgaagagaaagagcctgcagcccaacctgcagctgagcaagaagctgaagaccgtgctggaccaggccagacaggccagacagcacaagagaagagcccaggccagaatcagcagcaaggacgtgatgaagaagatcgccaactgcagcaagatccacctgagcaccaagctgctggccgtggacttccccgagcacttcgtgaagagcatcagctgccagatctgcgagcacatcctggccgaccccgtggagaccaactgcaagcacgtgttctgcagagtgtgcatcctgagatgcctgaaggtgatgggcagctactgccccagctgcagatacccctgcttccccaccgacctggagagccccgtgaagagcttcctgagcgtgctgaacagcctgatggtgaagtgccccgccaaggagtgcaacgaggaggtgagcctggagaagtacaaccaccacatcagcagccacaaggagagcaaggagatcttcgtgcacatcaacaagggcggcagacccagacagcacctgctgagcctgaccagaagagcccagaagcacagactgagagagctgaagctgcaggtgaaggccttcgccgacaaggaggagggcggcgacgtgaagagcgtgtgcatgaccctgttcctgctggccctgagagccagaaacgagcacagacaggccgacgagctggaggccatcatgcagggcaagggcagcggcctgcagcccgccgtgtgcctggccatcagagtgaacaccttcctgagctgcagccagtaccacaagatgtacagaaccgtgaaggccatcaccggcagacagatcttccagcccctgcacgccctgagaaacgccgagaaggtgctgctgcccggctaccaccacttcgagtggcagccccccctgaagaacgtgagcagcagcaccgacgtgggcatcatcgacggcctgagcggcctgagcagcagcgtggacgactaccccgtggacaccatcgccaagagattcagatacgacagcgccctggtgagcgccctgatggacatggaggaggacatcctggagggcatgagaagccaggacctggacgactacctgaacggccccttcaccgtggtggtgaaggagagctgcgacggcatgggcgacgtgagcgagaagcacggcagcggccccgtggtgcccgagaaggccgtgagattcagcttcaccatcatgaagatcaccatcgcccacagcagccagaacgtgaaggtgttcgaggaggccaagcccaacagcgagctgtgctgcaagcccctgtgcctgatgctggccgacgagagcgaccacgagaccctgaccgccatcctgagccccctgatcgccgagagagaggccatgaagagcagcgagctgatgctggagctgggcggcatcctgagaaccttcaagttcatcttcagaggcaccggctacgacgagaagctggtgagagaggtggagggcctggaggccagcggcagcgtgtacatctgcaccctgtgcgacgccaccagactggaggccagccagaacctggtgttccacagcatcaccagaagccacgccgagaacctggagagatacgaggtgtggagaagcaacccctaccacgagagcgtggaggagctgagagacagagtgaagggcgtgagcgccaagcccttcatcgagaccgtgcccagcatcgacgccctgcactgcgacatcggcaacgccgccgagttctacaagatcttccagctggagatcggcgaggtgtacaagaaccccaacgccagcaaggaggagagaaagagatggcaggccaccctggacaagcacctgagaaagaagatgaacctgaagcccatcatgagaatgaacggcaacttcgccagaaagctgatgaccaaggagaccgtggacgccgtgtgcgagctgatccccagcgaggagagacacgaggccctgagagagctgatggacctgtacctgaagatgaagcccgtgtggagaagcagctgccccgccaaggagtgccccgagagcctgtgccagtacagcttcaacagccagagattcgccgagctgctgagcaccaagttcaagtacagatacgagggcaagatcaccaactacttccacaagaccctggcccacgtgcccgagatcatcgagagagacggcagcatcggcgcctgggccagcgagggcaacgagagcggcaacaagctgttcagaagattcagaaagatgaacgccagacagagcaagtgctacgagatggaggacgtgctgaagcaccactggctgtacaccagcaagtacctgcagaagttcatgaacgcccacaacgccctgaagaccagcggcttcaccatgaacccccaggccagcctgggcgaccccctgggcatcgaggacagcctggagagccaggacagcatggagttctag

SEQ ID NO: 96564 - DNA, 1584 bp, Artificial Sequence
  Description of Artificial Sequence: Synthetic coding sequence
atgagcctgcagatggtgaccgtgagcaacaacatcgccctgatccagcccggcttcagcctgatgaacttcgacggccaggtgttcttcttcggccagaagggctggcccaagagaagctgccccaccggcgtgttccacctggacgtgaagcacaaccacgtgaagctgaagcccaccatcttcagcaaggacagctgctacctgccccccctgagataccccgccacctgcaccttcaagggcagcctggagagcgagaagcaccagtacatcatccacggcggcaagacccccaacaacgaggtgagcgacaagatctacgtgatgagcatcgtgtgcaagaacaacaagaaggtgaccttcagatgcaccgagaaggacctggtgggcgacgtgcccgaggccagatacggccacagcatcaacgtggtgtacagcagaggcaagagcatgggcgtgctgttcggcggcagaagctacatgcccagcacccacagaaccaccgagaagtggaacagcgtggccgactgcctgccctgcgtgttcctggtggacttcgagttcggctgcgccaccagctacatcctgcccgagctgcaggacggcctgagcttccacgtgagcatcgccaagaacgacaccatctacatcctgggcggccacagcctggccaacaacatcagacccgccaacctgtacagaatcagagtggacctgcccctgggcagccccgccgtgaactgcaccgtgctgcccggcggcatcagcgtgagcagcgccatcctgacccagaccaacaacgacgagttcgtgatcgtgggcggctaccagctggagaaccagaagagaatgatctgcaacatcatcagcctggaggacaacaagatcgagatcagagagatggagacccccgactggacccccgacatcaagcacagcaagatctggttcggcagcaacatgggcaacggcaccgtgttcctgggcatccccggcgacaacaagcaggtggtgagcgagggcttctacttctacatgctgaagtgcgccgaggacgacaccaacgaggagcagaccaccttcaccaacagccagaccagcaccgaggaccccggcgacagcacccccttcgaggacagcgaggagttctgcttcagcgccgaggccaacagcttcgacggcgacgacgagttcgacacctacaacgaggacgacgaggaggacgagagcgagaccggctactggatcacctgctgccccacctgcgacgtggacatcaacacctgggtgcccttctacagcaccgagctgaacaagcccgccatgatctactgcagccacggcgacggccactgggtgcacgcccagtgcatggacctggccgagagaaccctgatccacctgagcgccggcagcaacaagtactactgcaacgagcacgtggagatcgccagagccctgcacaccccccagagagtgctgcccctgaagaagccccccatgaagagcctgagaaagaagggcagcggcaagatcctgacccccgccaagaagagcttcctgagaagactgttcgactag

SEQ ID NO: 96565 - DNA, 216 bp, Artificial Sequence
  Description of Artificial Sequence: Synthetic coding sequence
atgagcctgcagatggtgaccgtgagcaacaacatcgccctgatccagcccggcttcagcctgatgaacttcgacggccaggtgttcttcttcggccagaagggctggcccaagagaagctgccccaccggcgtgttccacctggacgtgaagcacaaccacgtgaagctgaagcccaccatcttcagcaaggacagctgctacctgcccccctag

SEQ ID NO: 96566 - DNA, 453 bp, Artificial Sequence
  Description of Artificial Sequence: Synthetic coding sequence
atgagcctgcagatggtgaccgtgagcaacaacatcgccctgatccagcccggcttcagcctgatgaacttcgacggccaggtgttcttcttcggccagaagggctggcccaagagaagctgccccaccggcgtgttccacctggacgtgaagcacaaccacgtgaagctgaagcccaccatcttcagcaaggacagctgctacctgccccccctgagataccccgccacctgcaccttcaagggcagcctggagagcgagaagcaccagtacatcatccacggcggcaagacccccaacaacgaggtgagcgacaagatctacgtgatgagcatcgtgtgcaagaacaacaagaaggtgaccttcagatgcaccgagaaggacctggtgggcgacgtgcccgaggccagatacggccacagcatcaacgtggtgtacagcagaggcaagtag

SEQ ID NO: 96567 - DNA, 6 bp, Artificial Sequence
  Description of Artificial Sequence: Synthetic coding sequence
atgtag

SEQ ID NO: 96568 - DNA, 1503 bp, Artificial Sequence
  Description of Artificial Sequence: Synthetic coding sequence
atggaccacaccgagggcagccccgccgaggagccccccgcccacgcccccagccccggcaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgctggacgacgacgagagcgagggcgaggagttcaccgtgagagacggctacatccactacggccagaccgtgaagctggtgtgcagcgtgaccggcatggccctgcccagactgatcatcagaaaggtggacaagcagaccgccctgctggacgccgacgaccccgtgagccagctgcacaagtgcgccttctacctgaaggacaccgagagaatgtacctgtgcctgagccaggagagaatcatccagttccaggccaccccctgccccaaggagcccaacaaggagatgatcaacgacggcgccagctggaccatcatcagcaccgacaaggccgagtacaccttctacgagggcatgggccccgtgctggcccccgtgacccccgtgcccgtggtggagagcctgcagctgaacggcggcggcgacgtggccatgctggagctgaccggccagaacttcacccccaacctgagagtgtggttcggcgacgtggaggccgagaccatgtacagatgcggcgagagcatgctgtgcgtggtgcccgacatcagcgccttcagagagggctggagatgggtgagacagcccgtgcaggtgcccgtgaccctggtgagaaacgacggcatcatctacagcaccagcctgaccttcacctacacccccgagcccggccccagaccccactgcagcgccgccggcgccatcctgagagccaacagcagccaggtgccccccaacgagagcaacaccaacagcgagggcagctacaccaacgccagcaccaacagcaccagcgtgaccagcagcaccgccaccgtggtgagctag

SEQ ID NO: 96569 - DNA, 1461 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgctggacgacgacgagagcgagggcgaggagttcaccgtgagagacggctacatccactacggccagaccgtgaagctggtgtgcagcgtgaccggcatggccctgcccagactgatcatcagaaaggtggacaagcagaccgccctgctggacgccgacgaccccgtgagccagctgcacaagtgcgccttctacctgaaggacaccgagagaatgtacctgtgcctgagccaggagagaatcatccagttccaggccaccccctgccccaaggagcccaacaaggagatgatcaacgacggcgccagctggaccatcatcagcaccgacaaggccgagtacaccttctacgagggcatgggccccgtgctggcccccgtgacccccgtgcccgtggtggagagcctgcagctgaacggcggcggcgacgtggccatgctggagctgaccggccagaacttcacccccaacctgagagtgtggttcggcgacgtggaggccgagaccatgtacagatgcggcgagagcatgctgtgcgtggtgcccgacatcagcgccttcagagagggctggagatgggtgagacagcccgtgcaggtgcccgtgaccctggtgagaaacgacggcatcatctacagcaccagcctgaccttcacctacacccccgagcccggccccagaccccactgcagcgccgccggcgccatcctgagagccaacagcagccaggtgccccccaacgagagcaacaccaacagcgagggcagctacaccaacgccagcaccaacagcaccagcgtgaccagcagcaccgccaccgtggtgagctag

SEQ ID NO: 96570 - DNA, 1458 bp, Artificial Sequence
  Description of Artificial Sequence: Synthetic coding sequence
atgggcggctgcagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgctggacgacgacgagagcgagggcgaggagttcaccgtgagagacggctacatccactacggccagaccgtgaagctggtgtgcagcgtgaccggcatggccctgcccagactgatcatcagaaaggtggacaagcagaccgccctgctggacgccgacgaccccgtgagccagctgcacaagtgcgccttctacctgaaggacaccgagagaatgtacctgtgcctgagccaggagagaatcatccagttccaggccaccccctgccccaaggagcccaacaaggagatgatcaacgacggcgccagctggaccatcatcagcaccgacaaggccgagtacaccttctacgagggcatgggccccgtgctggcccccgtgacccccgtgcccgtggtggagagcctgcagctgaacggcggcggcgacgtggccatgctggagctgaccggccagaacttcacccccaacctgagagtgtggttcggcgacgtggaggccgagaccatgtacagatgcggcgagagcatgctgtgcgtggtgcccgacatcagcgccttcagagagggctggagatgggtgagacagcccgtgcaggtgcccgtgaccctggtgagaaacgacggcatcatctacagcaccagcctgaccttcacctacacccccgagcccggccccagaccccactgcagcgccgccggcgccatcctgagagccaacagcagccaggtgccccccaacgagagcaacaccaacagcgagggcagctacaccaacgccagcaccaacagcaccagcgtgaccagcagcaccgccaccgtggtgagctag

SEQ ID NO: 96571 - DNA, 1464 bp, Artificial Sequence
  Description of Artificial Sequence: Synthetic coding sequence
atggcccccgtggtgaccggcaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgctggacgacgacgagagcgagggcgaggagttcaccgtgagagacggctacatccactacggccagaccgtgaagctggtgtgcagcgtgaccggcatggccctgcccagactgatcatcagaaaggtggacaagcagaccgccctgctggacgccgacgaccccgtgagccagctgcacaagtgcgccttctacctgaaggacaccgagagaatgtacctgtgcctgagccaggagagaatcatccagttccaggccaccccctgccccaaggagcccaacaaggagatgatcaacgacggcgccagctggaccatcatcagcaccgacaaggccgagtacaccttctacgagggcatgggccccgtgctggcccccgtgacccccgtgcccgtggtggagagcctgcagctgaacggcggcggcgacgtggccatgctggagctgaccggccagaacttcacccccaacctgagagtgtggttcggcgacgtggaggccgagaccatgtacagatgcggcgagagcatgctgtgcgtggtgcccgacatcagcgccttcagagagggctggagatgggtgagacagcccgtgcaggtgcccgtgaccctggtgagaaacgacggcatcatctacagcaccagcctgaccttcacctacacccccgagcccggccccagaccccactgcagcgccgccggcgccatcctgagagccaacagcagccaggtgccccccaacgagagcaacaccaacagcgagggcagctacaccaacgccagcaccaacagcaccagcgtgaccagcagcaccgccaccgtggtgagctag

SEQ ID NO: 96572 - DNA, 1461 bp, Artificial Sequence; identical to SEQ ID NO: 96569
  Description of Artificial Sequence: Synthetic coding sequence

SEQ ID NO: 96573 - DNA, 1503 bp, Artificial Sequence; identical to SEQ ID NO: 96568
  Description of Artificial Sequence: Synthetic coding sequence

SEQ ID NO: 96574 - DNA, 432 bp, Artificial Sequence
  Description of Artificial Sequence: Synthetic coding sequence
atgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgactag

SEQ ID NO: 96575 - DNA, 87 bp, Artificial Sequence
  Description of Artificial Sequence: Synthetic coding sequence
atggcctggatcaagagaaagttcggcgagagacccccccccaagagactgaccagagaggccatgagaaactacctgaaggagtag

SEQ ID NO: 96576 - DNA, 294 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagtag

SEQ ID NO: 96577 - DNA, 1398 bp, Artificial Sequence
  Description of Artificial Sequence: Synthetic coding sequence
atgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgctggacgacgacgagagcgagggcgaggagttcaccgtgagagacggctacatccactacggccagaccgtgaagctggtgtgcagcgtgaccggcatggccctgcccagactgatcatcagaaaggtggacaagcagaccgccctgctggacgccgacgaccccgtgagccagctgcacaagtgcgccttctacctgaaggacaccgagagaatgtacctgtgcctgagccaggagagaatcatccagttccaggccaccccctgccccaaggagcccaacaaggagatgatcaacgacggcgccagctggaccatcatcagcaccgacaaggccgagtacaccttctacgagggcatgggccccgtgctggcccccgtgacccccgtgcccgtggtggagagcctgcagctgaacggcggcggcgacgtggccatgctggagctgaccggccagaacttcacccccaacctgagagtgtggttcggcgacgtggaggccgagaccatgtacagatgcggcgagagcatgctgtgcgtggtgcccgacatcagcgccttcagagagggctggagatgggtgagacagcccgtgcaggtgcccgtgaccctggtgagaaacgacggcatcatctacagcaccagcctgaccttcacctacacccccgagcccggccccagaccccactgcagcgccgccggcgccatcctgagagccaacagcagccaggtgccccccaacgagagcaacaccaacagcgagggcagctacaccaacgccagcaccaacagcaccagcgtgaccagcagcaccgccaccgtggtgagctag

SEQ ID NO: 96578 - DNA, 474 bp, Artificial Sequence
  Description of Artificial Sequence: Synthetic coding sequence
atgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagatag

SEQ ID NO: 96579 - DNA, 150 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagtag

SEQ ID NO: 96580 - DNA, 324 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactag

SEQ ID NO: 96581 - DNA, 285 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagctag

SEQ ID NO: 96582 - DNA, 537 bp, Artificial Sequence
  Description of Artificial Sequence: Synthetic coding sequence
atggaccacaccgagggcagccccgccgaggagccccccgcccacgcccccagccccggcaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgactag

SEQ ID NO: 96583 - DNA, 333 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcacctag

SEQ ID NO: 96584 - DNA, 342 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagacctag

SEQ ID NO: 96585 - DNA, 147 bp, Artificial Sequence
  Description of Artificial Sequence: Synthetic coding sequence
atggcctggatcaagagaaagttcggcgagagacccccccccaagagactgaccagagaggccatgagaaactacctgaaggagagaggcgaccagaccgtgctgatcctgcacgccaaggtggcccagaagagctacggcaactag

SEQ ID NO: 96586 - DNA, 570 bp, Artificial Sequence
  Description of Artificial Sequence: Synthetic coding sequence
atgagaaactacctgaaggagagaggcgaccagaccgtgctgatcctgcacgccaaggtggcccagaagagctacggcaacgagaagagattcttctgcccccccccctgcgtgtacctgatgggcagcggctggaagaagaagaaggagcagatggagagagacggctgcagcgagcaggagagccagccctgcgccttcatcggcatcggcaacagcgaccaggagatgcagcagctgaacctggagggcaagaactactgcaccgccaagaccctgtacatcagcgacagcgacaagagaaagcacttcatgctgagcgtgaagatgttctacggcaacagcgacgacatcggcgtgttcctgagcaagagaatcaaggtgatcagcaagcccagcaagaagaagcagagcctgaagaacgccgacctgtgcatcgccagcggcaccaaggtggccctgttcaacagactgagaagccagaccgtgagcaccagatacctgcacgtggagggcggcaacttccacgccagcagccagcagtggggcgccttcttcatccacctgtag

SEQ ID NO: 96587 - DNA, 600 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctggagaccatcaacgtgaccatggccggcaaggaggtgttcctggtgatgcccaccggcggcggcaagagcctgtgctaccagctgcccgccctgtgcagcgacggcttcaccctggtgatctgccccctgatcagcctgatggaggaccagctgatggtgctgaagcagctgggcatcagcgccaccatgctgaacgccagcagcagcaaggagcacgtgaagtgggtgcacgccgagatggtgaacaagaacagcgagctgaagctgatctacgtgacccccgagaagatcgccaagagcaagatgtag

SEQ ID NO: 96588 - DNA, 636 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctggagaccatcaacgtgaccatggccggcaaggaggtgttcctggtgatgcccaccggcggcggcaagagcctgtgctaccagctgcccgccctgtgcagcgacggcttcaccctggtgatctgccccctgatcagcctgatggaggaccagctgatggtgctgaagcagctgggcatcagcgccaccatgctgaacgccagcagcagcaaggagcacgtgaagtgggtgcacgccgagatggtgaacaagaacagcgagctgaagctgatctacgtgacccccgagaagatcgccaagagcaagatgttcatgagcagactggagaaggcctacgaggccagatag

SEQ ID NO: 96589 - DNA, 1950 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctggagaccatcaacgtgaccatggccggcaaggaggtgttcctggtgatgcccaccggcggcggcaagagcctgtgctaccagctgcccgccctgtgcagcgacggcttcaccctggtgatctgccccctgatcagcctgatggaggaccagctgatggtgctgaagcagctgggcatcagcgccaccatgctgaacgccagcagcagcaaggagcacgtgaagtgggtgcacgccgagatggtgaacaagaacagcgagctgaagctgatctacgtgacccccgagaagatcgccaagagcaagatgttcatgagcagactggagaaggcctacgaggccagaagattcaccagaatcgccgtggacgaggtgcactgctgcagccagtggggccacgacttcagacccgactacaaggccctgggcatcctgaagagacagttccccaacgccagcctgatcggcctgaccgccaccgccaccaaccacgtgctgaccgacgcccagaagatcctgtgcatcgagaagtgcttcaccttcaccgccagcttcaacagacccaacctgtactacgaggtgagacagaagcccagcaacaccgaggacttcatcgaggacatcgtgaagctgatcaacggcagatacaagggccagagcggcatcatctactgcttcagccagaaggacagcgagcaggtgaccgtgagcctgcagaacctgggcatccacgccggcgcctaccacgccaacctggagcccgaggacaagaccaccgtgcacagaaagtggagcgccaacgagatccaggtggtggtggccaccgtggccttcggcatgggcatcgacaagcccgacgtgagattcgtgatccaccacagcatgagcaagagcatggagaactactaccaggagagcggcagagccggcagagacgacatgaaggccgactgcatcctgtactacggcttcggcgacatcttcagaatcagcagcatggtggtgatggagaacgtgggccagcagaagctgtacgagatggtgagctactgccagaacatcagcaagtgcagaagagtgctgatggcccagcacttcgacgaggtgtggaacagcgaggcctgcaacaagatgtgcgacaactgctgcaaggacagcgccttcgagagaaagaacatcaccgagtactgcagagacctgatcaagatcctgaagcaggccgaggagctgaacgagaagctgacccccctgaagctgatcgacagctggatgggcaagggcgccgccaagctgagagtggccggcgtggtggcccccaccctgcccagagaggacctggagaagatcatcgcccacttcctgatccagcagtacctgaaggaggactacagcttcaccgcctacgccaccatcagctacctgaagatcggccccaaggccaacctgctgaacaacgaggcccacgccatcaccatgcaggtgaccaagagcacccagaacagcttcagagccgagagcagccagacctgccacagcgagcagggcgacaagaagatggaggagaagaacagcggcaacttccagaagaaggccgccaacatgctgcagcagagcggcagcaagaacaccggcgccaagaagagaaagatcgacgacgcctag

SEQ ID NO: 96590 - DNA, 1950 bp, Artificial Sequence; identical to SEQ ID NO: 96589
  Description of Artificial Sequence: Synthetic coding sequence

SEQ ID NO: 96591 - DNA, 321 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctggagaccatcaacgtgaccatggccggctag

SEQ ID NO: 96592 - DNA, 294 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctgtag

SEQ ID NO: 96593 - DNA, 219 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggactag

SEQ ID NO: 96594 - DNA, 396 bp, Artificial Sequence
  Description of Artificial Sequence: Synthetic coding sequence
atggccagcgtgagcgccctgaccgaggagctggacagcatcaccagcgagctgcacgccgtggagatccagatccaggagctgaccgagagacagcaggagctgatccagaagaagaaggtgctgaccaagaagatcaagcagtgcctggaggacagcgacgccggcgccagcaacgagtacgacagcagccccgccgcctggaacaaggaggacttcccctggagcggcaaggtgaaggacatcctgcagaacgtgttcaagctggagaagttcagacccctgcagctggagaccatcaacgtgaccatggccggcaaggaggtgttcctggtgatgcccaccggcggcggcaagagcctgtgctaccagctgcccgccctgtgcagcgactag

SEQ ID NO: 96595 - DNA, 2976 bp, Artificial Sequence
  Description of Artificial Sequence: Synthetic coding sequence
atgagcagccaccacaccaccttccccttcgaccccgagagaagagtgagaagcaccctgaagaaggtgttcggcttcgacagcttcaagacccccctgcaggagagcgccaccatggccgtggtgaagggcaacaaggacgtgttcgtgtgcatgcccaccggcgccggcaagagcctgtgctaccagctgcccgccctgctggccaagggcatcaccatcgtggtgagccccctgatcgccctgatccaggaccaggtggaccacctgctgaccctgaaggtgagagtgagcagcctgaacagcaagctgagcgcccaggagagaaaggagctgctggccgacctggagagagagaagccccagaccaagatcctgtacatcacccccgagatggccgccagcagcagcttccagcccaccctgaacagcctggtgagcagacacctgctgagctacctggtggtggacgaggcccactgcgtgagccagtggggccacgacttcagacccgactacctgagactgggcgccctgagaagcagactgggccacgccccctgcgtggccctgaccgccaccgccaccccccaggtgcaggaggacgtgttcgccgccctgcacctgaagaagcccgtggccatcttcaagaccccctgcttcagagccaacctgttctacgacgtgcagttcaaggagctgatcagcgacccctacggcaacctgaaggacttctgcctgaaggccctgggccaggaggccgacaagggcctgagcggctgcggcatcgtgtactgcagaaccagagaggcctgcgagcagctggccatcgagctgagctgcagaggcgtgaacgccaaggcctaccacgccggcctgaaggccagcgagagaaccctggtgcagaacgactggatggaggagaaggtgcccgtgatcgtggccaccatcagcttcggcatgggcgtggacaaggccaacgtgagattcgtggcccactggaacatcgccaagagcatggccggctactaccaggagagcggcagagccggcagagacggcaagcccagctggtgcagactgtactacagcagaaacgacagagaccaggtgagcttcctgatcagaaaggaggtggccaagctgcaggagaagagaggcaacaaggccagcgacaaggccaccatcatggccttcgacgccctggtgaccttctgcgaggagctgggctgcagacacgccgccatcgccaagtacttcggcgacgccctgcccgcctgcgccaagggctgcgaccactgccagaaccccaccgccgtgagaagaagactggaggccctggagagaagcagcagctggagcaagacctgcatcggccccagccagggcaacggcttcgaccccgagctgtacgagggcggcagaaagggctacggcgacttcagcagatacgacgagggcagcggcggcagcggcgacgagggcagagacgaggcccacaagagagagtggaacctgttctaccagaagcagatgcagctgagaaagggcaaggaccccaagatcgaggagttcgtgccccccgacgagaactgccccctgaaggaggccagcagcagaagaatccccagactgaccgtgaaggccagagagcactgcctgagactgctggaggaggccctgagcagcaacagacagagcaccagaaccgccgacgaggccgacctgagagccaaggccgtggagctggagcacgagaccttcagaaacgccaaggtggccaacctgtacaaggccagcgtgctgaagaaggtggccgacatccacagagccagcaaggacggccagccctacgacatgggcggcagcgccaagagctgcagcgcccaggccgagccccccgagcccaacgagtacgacatcccccccgccagccacgtgtacagcctgaagcccaagagagtgggcgccggcttccccaagggcagctgccccttccagaccgccaccgagctgatggagaccaccagaatcagagagcaggccccccagcccgagagaggcggcgagcacgagccccccagcagaccctgcggcctgctggacgaggacggcagcgagcccctgcccggccccagaggcgaggtgcccggcggcagcgcccactacggcggccccagccccgagaagaaggccaagagcagcagcggcggcagcagcctggccaagggcagagccagcaagaagcagcagctgctggccaccgccgcccacaaggacagccagagcatcgccagattcttctgcagaagagtggagagccccgccctgctggccagcgcccccgaggccgagggcgcctgccccagctgcgagggcgtgcagggcccccccatggcccccgagaagtacaccggcgaggaggacggcgccggcggccacagccccgcccccccccagaccgaggagtgcctgagagagagacccagcacctgcccccccagagaccagggcacccccgaggtgcagcccacccccgccaaggacacctggaagggcaagagacccagaagccagcaggagaaccccgagagccagccccagaagagacccagacccagcgccaagcccagcgtggtggccgaggtgaagggcagcgtgagcgccagcgagcagggcaccctgaaccccaccgcccaggaccccttccagctgagcgcccccggcgtgagcctgaaggaggccgccaacgtggtggtgaagtgcctgacccccttctacaaggagggcaagttcgccagcaaggagctgttcaagggcttcgccagacacctgagccacctgctgacccagaagaccagccccggcagaagcgtgaaggaggaggcccagaacctgatcagacacttcttccacggcagagccagatgcgagagcgaggccgactggcacggcctgtgcggcccccagagatag

SEQ ID NO: 96596 - DNA, 1308 bp, Artificial Sequence
  Description of Artificial Sequence: Synthetic coding sequence
atgagcagccaccacaccaccttccccttcgaccccgagagaagagtgagaagcaccctgaagaaggtgttcggcttcgacagcttcaagacccccctgcaggagagcgccaccatggccgtggtgaagggcaacaaggacgtgttcgtgtgcatgcccaccggcgccggcaagagcctgtgctaccagctgcccgccctgctggccaagggcatcaccatcgtggtgagccccctgatcgccctgatccaggaccaggtggaccacctgctgaccctgaaggtgagagtgagcagcctgaacagcaagctgagcgcccaggagagaaaggagctgctggccgacctggagagagagaagccccagaccaagatcctgtacatcacccccgagatggccgccagcagcagcttccagcccaccctgaacagcctggtgagcagacacctgctgagctacctggtggtggacgaggcccactgcgtgagccagtggggccacgacttcagacccgactacctgagactgggcgccctgagaagcagactgggccacgccccctgcgtggccctgaccgccaccgccaccccccaggtgcaggaggacgtgttcgccgccctgcacctgaagaagcccgtggccatcttcaagaccccctgcttcagagccaacctgttctacgacgtgcagttcaaggagctgatcagcgacccctacggcaacctgaaggacttctgcctgaaggccctgggccaggaggccgacaagggcctgagcggctgcggcatcgtgtactgcagaaccagagaggcctgcgagcagctggccatcgagctgagctgcagaggcgtgaacgccaaggcctaccacgccggcctgaaggccagcgagagaaccctggtgcagaacgactggatggaggagaaggtgcccgtgatcgtggccaccatcagcttcggcatgggcgtggacaaggccaacgtgagattcgtggcccactggaacatcgccaagagcatggccggctactaccaggagagcggcagagccggcagagacggcaagcccagctggtgcagactgtactacagcagaaacgacagagaccaggtgagcttcctgatcagaaaggaggtggccaagctgcaggagaagagaggcaacaaggccagcgacaaggccaccatcatggccttcgacgccctggtgaccttctgcgaggagctgggcagatggggcagaggccacggcaagagcctgagagccgcctggtgcagccaggtggtgagcagacacgccgagctgtag

SEQ ID NO: 96597 - DNA, 1233 bp, Artificial Sequence
  Description of Artificial Sequence: Synthetic coding sequence
atgagcagccaccacaccaccttccccttcgaccccgagagaagagtgagaagcaccctgaagaaggtgttcggcttcgacagcttcaagacccccctgcaggagagcgccaccatggccgtggtgaagggcaacaaggacgtgttcgtgtgcatgcccaccggcgccggcaagagcctgtgctaccagctgcccgccctgctggccaagggcatcaccatcgtggtgagccccctgatcgccctgatccaggaccaggtggaccacctgctgaccctgaaggtgagagtgagcagcctgaacagcaagctgagcgcccaggagagaaaggagctgctggccgacctggagagagagaagccccagaccaagatcctgtacatcacccccgagatggccgccagcagcagcttccagcccaccctgaacagcctggtgagcagacacctgctgagctacctggtggtggacgaggcccactgcgtgagccagtggggccacgacttcagacccgactacctgagactgggcgccctgagaagcagactgggccacgccccctgcgtggccctgaccgccaccgccaccccccaggtgcaggaggacgtgttcgccgccctgcacctgaagaagcccgtggccatcttcaagaccccctgcttcagagccaacctgttctacgacgtgcagttcaaggagctgatcagcgacccctacggcaacctgaaggacttctgcctgaaggccctgggccaggaggccgacaagggcctgagcggctgcggcatcgtgtactgcagaaccagagaggcctgcgagcagctggccatcgagctgagctgcagaggcgtgaacgccaaggcctaccacgccggcctgaaggccagcgagagaaccctggtgcagaacgactggatggaggagaaggtgcccgtgatcgtggccaccatcagcttcggcatgggcgtggacaaggccaacgtgagattcgtggcccactggaacatcgccaagagcatggccggctactaccaggagagcggcagagccggcagagacggcaagcccagctggtgcagactgtactacagcagaaacgacagagaccaggtgagcttcctgatcagaaaggaggtggccaagctgcaggagaagagaggcaacaaggccagcgacaaggccaccatcatggccttcgacgccctggtgaccttctgcgaggagctgggctag

SEQ ID NO: 96598 - DNA, 3057 bp, Artificial Sequence
  Description of Artificial Sequence: Synthetic coding sequence
atgagcagccaccacaccaccttccccttcgaccccgagagaagagtgagaagcaccctgaagaaggtgttcggcttcgacagcttcaagacccccctgcaggagagcgccaccatggccgtggtgaagggcaacaaggacgtgttcgtgtgcatgcccaccggcgccggcaagagcctgtgctaccagctgcccgccctgctggccaagggcatcaccatcgtggtgagccccctgatcgccctgatccaggaccaggtggaccacctgctgaccctgaaggtgagagtgagcagcctgaacagcaagctgagcgcccaggagagaaaggagctgctggccgacctggagagagagaagccccagaccaagatcctgtacatcacccccgagatggccgccagcagcagcttccagcccaccctgaacagcctggtgagcagacacctgctgagctacctggtggtggacgaggcccactgcgtgagccagtggggccacgacttcagacccgactacctgagactgggcgccctgagaagcagactgggccacgccccctgcgtggccctgaccgccaccgccaccccccaggtgcaggaggacgtgttcgccgccctgcacctgaagaagcccgtggccatcttcaagaccccctgcttcagagccaacctgttctacgacgtgcagttcaaggagctgatcagcgacccctacggcaacctgaaggacttctgcctgaaggccctgggccaggaggccgacaagggcctgagcggctgcggcatcgtgtactgcagaaccagagaggcctgcgagcagctggccatcgagctgagctgcagaggcgtgaacgccaaggcctaccacgccggcctgaaggccagcgagagaaccctggtgcagaacgactggatggaggagaaggtgcccgtgatcgtggccaccatcagcttcggcatgggcgtggacaaggccaacgtgagattcgtggcccactggaacatcgccaagagcatggccggctactaccaggagagcggcagagccggcagagacggcaagcccagctggtgcagactgtactacagcagaaacgacagagaccaggtgagcttcctgatcagaaaggaggtggccaagctgcaggagaagagaggcaacaaggccagcgacaaggccaccatcatggccttcgacgccctggtgaccttctgcgaggagctgggctgcagacacgccgccatcgccaagtacttcggcgacgccctgcccgcctgcgccaagggctgcgaccactgccagaaccccaccgccgtgagaagaagactggaggccctggagagaagcagcagctggagcaagacctgcatcggccccagccagggcaacggcttcgaccccgagctgtacgagggcggcagaaagggctacggcgacttcagcagatacgacgagggcagcggcggcagcggcgacgagggcagagacgaggcccacaagagagagtggaacctgttctaccagaagcagatgcagctgagaaagggcaaggaccccaagatcgaggagttcgtgccccccgacgagaactgccccctgaaggaggccagcagcagaagaatccccagactgaccgtgaaggccagagagcactgcctgagactgctggaggaggccctgagcagcaacagacagagcaccagaaccgccgacgaggccgacctgagagccaaggccgtggagctggagcacgagaccttcagaaacgccaaggtggccaacctgtacaaggccagcgtgctgaagaaggtggccgacatccacagagccagcaaggacggccagccctacgacatgggcggcagcgccaagagctgcagcgcccaggccgagccccccgagcccaacgagtacgacatcccccccgccagccacgtgtacagcctgaagcccaagagagtgggcgccggcttccccaagggcagctgccccttccagaccgccaccgagctgatggagaccaccagaatcagagagcaggccccccagcccgagagaggcggcgagcacgagccccccagcagaccctgcggcctgctggacgaggacggcagcgagcccctgcccggccccagaggcgaggtgcccggcggcagcgcccactacggcggccccagccccgagaagaaggccaagagcagcagcggcggcagcagcctggccaagggcagagccagcaagaagcagcagctgctggccaccgccgcccacaaggacagccagagcatcgccagattcttctgcagaagagtggagagccccgccctgctggccagcgcccccgaggccgagggcgcctgccccagctgcgagggcgtgcagggcccccccatggcccccgagaagtacaccggcgaggaggacggcgccggcggccacagccccgcccccccccagaccgaggagtgcctgagagagagacccagcacctgcccccccagagaccagggcacccccgaggtgcagcccacccccgccaaggacacctggaagggcaagagacccagaagccagcaggagaaccccgagagccagccccagaagagacccagacccagcgccaagcccagcgtggtggccgaggtgaagggcagcgtgagcgccagcgagcagggcaccctgaaccccaccgcccaggaccccttccagctgagcgcccccggcgtgagcctgaaggaggccgccaacgtggtggtgaagtgcctgacccccttctacaaggagggcaagttcgccagcaaggagctgttcaagggcttcgccagacacctgagccacctgctgacccagaagaccagccccggcagaagcgtgaaggaggaggcccagaacctgatcagacacttcttccacggcagagccagatgcgagagcggcccccacggctgggtgttctgggacacctgcagaggccagaaggtggagggcggcggcgccgccgccggcagaagaggcagaaagagcggccccagccccagcagcaagagcggctag

SEQ ID NO: 96599 - DNA, 1761 bp, Artificial Sequence
  Description of Artificial Sequence: Synthetic coding sequence
atgttcctggtgagatgcagacacgccgccatcgccaagtacttcggcgacgccctgcccgcctgcgccaagggctgcgaccactgccagaaccccaccgccgtgagaagaagactggaggccctggagagaagcagcagctggagcaagacctgcatcggccccagccagggcaacggcttcgaccccgagctgtacgagggcggcagaaagggctacggcgacttcagcagatacgacgagggcagcggcggcagcggcgacgagggcagagacgaggcccacaagagagagtggaacctgttctaccagaagcagatgcagctgagaaagggcaaggaccccaagatcgaggagttcgtgccccccgacgagaactgccccctgaaggaggccagcagcagaagaatccccagactgaccgtgaaggccagagagcactgcctgagactgctggaggaggccctgagcagcaacagacagagcaccagaaccgccgacgaggccgacctgagagccaaggccgtggagctggagcacgagaccttcagaaacgccaaggtggccaacctgtacaaggccagcgtgctgaagaaggtggccgacatccacagagccagcaaggacggccagccctacgacatgggcggcagcgccaagagctgcagcgcccaggccgagccccccgagcccaacgagtacgacatcccccccgccagccacgtgtacagcctgaagcccaagagagtgggcgccggcttccccaagggcagctgccccttccagaccgccaccgagctgatggagaccaccagaatcagagagcaggccccccagcccgagagaggcggcgagcacgagccccccagcagaccctgcggcctgctggacgaggacggcagcgagcccctgcccggccccagaggcgaggtgcccggcggcagcgcccactacggcggccccagccccgagaagaaggccaagagcagcagcggcggcagcagcctggccaagggcagagccagcaagaagcagcagctgctggccaccgccgcccacaaggacagccagagcatcgccagattcttctgcagaagagtggagagccccgccctgctggccagcgcccccgaggccgagggcgcctgccccagctgcgagggcgtgcagggcccccccatggcccccgagaagtacaccggcgaggaggacggcgccggcggccacagccccgcccccccccagaccgaggagtgcctgagagagagacccagcacctgcccccccagagaccagggcacccccgaggtgcagcccacccccgccaaggacacctggaagggcaagagacccagaagccagcaggagaaccccgagagccagccccagaagagacccagacccagcgccaagcccagcgtggtggccgaggtgaagggcagcgtgagcgccagcgagcagggcaccctgaaccccaccgcccaggaccccttccagctgagcgcccccggcgtgagcctgaaggaggccgccaacgtggtggtgaagtgcctgacccccttctacaaggagggcaagttcgccagcaaggagctgttcaagggcttcgccagacacctgagccacctgctgacccagaagaccagccccggcagaagcgtgaaggaggaggcccagaacctgatcagacacttcttccacggcagagccagatgcgagagcgaggccgactggcacggcctgtgcggcccccagagatag

SEQ ID NO: 96600 - DNA, 1200 bp, Artificial Sequence; identical to SEQ ID NO: 86527
  Description of Artificial Sequence: Synthetic coding sequence

SEQ ID NO: 96601 - DNA, 528 bp, Artificial Sequence
  Description of Artificial Sequence: Synthetic coding sequence
atgctgccccccatggccctgcccagcgtgagctggatgctgctgagctgcctgatcctgctgtgccaggtgcagggcgaggagacccagaaggagctgcccagccccagaatcagctgccccaagggcagcaaggcctacggcagcccctgctacgccctgttcctgagccccaagagctggatggacgccgacctggcctgccagaagagacccagcggcaagctggtgagcgtgctgagcggcgccgagggcagcttcgtgagcagcctggtgagaagcatcagcaacagctacagctacatctggatcggcctgcacgaccccacccagggcagcgagcccgacggcgacggctgggagtggagcagcaccgacgtgatgaactacttcgcctgggagaagaaccccagcaccatcctgaaccccggccactgcggcagcctgagcagaagcaccggcttcctgaagtggaaggactacaactgcgacgccaagctgccctacgtgtgcaagttcaaggactag

SEQ ID NO: 96602 - DNA, 528 bp, Artificial Sequence; identical to SEQ ID NO: 96601
  Description of Artificial Sequence: Synthetic coding sequence

SEQ ID NO: 96603 - DNA, 390 bp, Artificial Sequence
  Description of Artificial Sequence: Synthetic coding sequence
atgctgccccccatggccctgcccagcgtgagctggatgctgctgagctgcctgatcctgctgtgccaggtgcagggcgaggagacccagaaggagctgcccagccccagaatcagctgccccaagggcagcaaggcctacggcagcccctgctacgccctgttcctgagccccaagagctggatggacgccgacggcagcgagcccgacggcgacggctgggagtggagcagcaccgacgtgatgaactacttcgcctgggagaagaaccccagcaccatcctgaaccccggccactgcggcagcctgagcagaagcaccggcttcctgaagtggaaggactacaactgcgacgccaagctgccctacgtgtgcaagttcaaggactag

SEQ ID NO: 96604 - DNA, 477 bp, Artificial Sequence
  Description of Artificial Sequence: Synthetic coding sequence
atggccagcagaagcatgagactgctgctgctgctgagctgcctggccaagaccggcgtgctgggcgacatcatcatgagacccagctgcgcccccggctggttctaccacaagagcaactgctacggctacttcagaaagctgagaaactggagcgacgccgagctggagtgccagagctacggcaacggcgcccacctggccagcatcctgagcctgaaggaggccagcaccatcgccgagtacatcagcggctaccagagaagccagcccatctggatcggcctgcacgacccccagaagagacagcagtggcagtggatcgacggcgccatgtacctgtacagaagctggagcggcaagagcatgggcggcaacaagcactgcgccgagatgagcagcaacaacaacttcctgacctggagcagcaacgagtgcaacaagagacagcacttcctgtgcaagtacagaccctag

SEQ ID NO: 96605 - DNA, 477 bp, Artificial Sequence; identical to SEQ ID NO: 96604
  Description of Artificial Sequence: Synthetic coding sequence

SEQ ID NO: 96606 - DNA, 405 bp, Artificial Sequence
  Description of Artificial Sequence: Synthetic coding sequence
atggccagcagaagcatgagactgctgctgctgctgagctgcctggccaagaccggcgtgctgggcgacatcatcatgagacccagctgcgcccccggctggttctaccacaagagcaactgctacggctacttcagaaagctgagaaactggagcgacgccgaggtgagaaacctgctgcccgcctggcccggcctgagcagagccaaggaccagcccgagccccagatcagcttcgacagcggcagcagcgtgctgcccggccactacgaggagaagcccctgtggctggtgaagtggagagaggagggctgcgtgttcaacagcttcaacagcgtgagcatcgccgaggccggcgccgtgtgccagaccctggacggcctgcaggcccacaccgacacctag

SEQ ID NO: 96607 - DNA, 375 bp, Artificial Sequence
  Description of Artificial Sequence: Synthetic coding sequence
atggccagcagaagcatgagactgctgctgctgctgagctgcctggccaagaccggcgtgctgggcgacatcatcatgagacccagctgcgcccccggctggttctaccacaagagcaactgctacggctacttcagaaagctgagaaactggagcgacgccgagctggagtgccagagctacggcaacggcgcccacctggccagcatcctgagcctgaaggaggccagcaccatcgccgagtacatcagcggctaccagagaagccagcccatctggatcggcctgcacgacccccagaagcagcccctgaacagctgcctgttcttcctgtggccctgggagggcctgcccgtggagagcctgctgggctag

SEQ ID NO: 96608 - DNA, 900 bp, Artificial Sequence
  Description of Artificial Sequence: Synthetic coding sequence
atgagcagcatcaagatcgagtgcgtgctgcccgagaactgcagatgcggcgagagccccgtgtgggaggaggtgagcaacagcctgctgttcgtggacatccccgccaagaaggtgtgcagatgggacagcttcaccaagcaggtgcagagagtgaccatggacgcccccgtgagcagcgtggccctgagacagagcggcggctacgtggccaccatcggcaccaagttctgcgccctgaactggaaggagcagagcgccgtggtgctggccaccgtggacaacgacaagaagaacaacagattcaacgacggcaaggtggaccccgccggcagatacttcgccggcaccatggccgaggagaccgcccccgccgtgctggagagacaccagggcgccctgtacagcctgttccccgaccaccacgtgaagaagtacttcgaccaggtggacatcagcaacggcctggactggagcctggaccacaagatcttctactacatcgacagcctgagctacagcgtggacgccttcgactacgacctgcagaccggccagatcagcaacagaagaagcgtgtacaagctggagaaggaggagcagatccccgacggcatgtgcatcgacgccgagggcaagctgtgggtggcctgctacaacggcggcagagtgatcagactggaccccgtgaccggcaagagactgcagaccgtgaagctgcccgtggacaagaccaccagctgctgcttcggcggcaagaactacagcgagatgtacgtgacctgcgccagagacggcatggaccccgagggcctgctgagacagcccgaggccggcggcatcttcaagatcaccggcctgggcgtgaagggcatcgccccctacagctacgccggctag

SEQ ID NO: 96609 - DNA, 900 bp, Artificial Sequence; identical to SEQ ID NO: 96608
  Description of Artificial Sequence: Synthetic coding sequence

SEQ ID NO: 96610 - DNA, 900 bp, Artificial Sequence; identical to SEQ ID NO: 96608
  Description of Artificial Sequence: Synthetic coding sequence

SEQ ID NO: 96611 - DNA, 684 bp, Artificial Sequence
  Description of Artificial Sequence: Synthetic coding sequence
atgagcagcatcaagatcgagtgcgtgctgcccgagaactgcagatgcggcgagagccccgtgtgggaggaggtgagcaacagcctgctgttcgtggacatccccgccaagaaggtgtgcagatgggacagcttcaccaagcaggtgcagagagtgaccatggacgcccccgtgagcagcgtggccctgagacagagcggcggctacgtggccaccatcggcaccaagttctgcgccctgaactggaaggagcagagcgccgtggtgctggccaccgtggacaacgacaagaagaacaacagattcaacgacggcaaggtggaccccgccggcagatacttcgccgccaacagaagaagcgtgtacaagctggagaaggaggagcagatccccgacggcatgtgcatcgacgccgagggcaagctgtgggtggcctgctacaacggcggcagagtgatcagactggaccccgtgaccggcaagagactgcagaccgtgaagctgcccgtggacaagaccaccagctgctgcttcggcggcaagaactacagcgagatgtacgtgacctgcgccagagacggcatggaccccgagggcctgctgagacagcccgaggccggcggcatcttcaagatcaccggcctgggcgtgaagggcatcgccccctacagctacgccggctag

SEQ ID NO: 96612 - DNA, 3876 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgaggacaagtacgtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96613 - DNA, 4428 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgaggacatctgcgtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96614 - DNA, 4116 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgagaacaagatcgtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagaggcagatggagccccagcctggacagaagaagaccccccagccccagaatccagatccagcacgccagccccgagaacgacagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96615 - DNA, 4626 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgaggacaagtacgtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagacacctggtgagacactacaagaccctgccccccaagatgcccctgctgcagagcagcagccactggaacatctacagcgagctgcagcccttcctggacagagccagaagcgccagcaccaactgcctgagacccgacaccagcctgcacagccccgagagagagagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96616 - DNA, 4446 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgagaacaagatcgtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatggccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96617 - DNA, 4446 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgaggacaaggtggtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatggccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96618 - DNA, 5079 bp, Artificial Sequence
  Description of Artificial Sequence: Synthetic coding sequence
atgagcagcgccgtgggccccagaggccccagaccccccaccgtgcccccccccatgcaggagctgcccgacctgagccacctgaccgaggaggagagaaacatcatcatggccgtgatggacagacagaaggaggaggaggagaaggaggaggccatgctgaagtgcgtggtgagagacatggccaagcccgccgcctgcaagacccccagaaacgccgagaaccagccccaccagcccagccccagactgcaccagcagttcgagagctacaaggagcaggtgagaaagatcggcgaggaggccagaagataccagggcgagcacaaggacgacgcccccacctgcggcatctgccacaagaccaagttcgccgacggctgcggccacctgtgcagctactgcagaaccaagttctgcgccagatgcggcggcagagtgagcctgagaagcaacaacgaggacaaggtggtgatgtgggtgtgcaacctgtgcagaaagcagcaggagatcctgaccaagagcggcgcctggttcttcggcagcggcccccagcagaccagccaggacggcaccctgagcgacaccgccaccggcgccggcagcgaggtgcccagagagaagaaggccagactgcaggagagaagcagaagccagacccccctgagcaccgccgccgccagcagccaggacgccgccccccccagcgccccccccgacagaagcaagggcgccgagcccagccagcaggccctgggccccgagcagaagcaggccagcagcagaagcagaagcgagccccccagagagagaaagaagacccccggcctgagcgagcagaacggcaagggcgccctgaagagcgagagaaagagagtgcccaagaccagcgcccagcccgtggagggcgccgtggaggagagagagagaaaggagagaagagagagcagaagactggagaagggcagaagccaggactaccccgacacccccgagaagagagacgagggcaaggccgccgacgaggagaagcagagaaaggaggaggactaccagaccagatacagaagcgaccccaacctggccagataccccgtgaagcccccccccgaggagcagcagatgagaatgcacgccagagtgagcagagccagacacgagagaagacacagcgacgtggccctgcccagaaccgaggccggcgccgccctgcccgagggcaaggccggcaagagagcccccgccgccgccagagccagcccccccgacagccccagagcctacagcgccgagagaaccgccgagaccagagcccccggcgccaagcagctgaccaaccacagcccccccgcccccagacacggccccgtgcccgccgaggcccccgagctgaaggcccaggagcccctgagaaagcagagcagactggaccccagcagcgccgtgctgatgagaaaggccaagagagagaaggtggagaccatgctgagaaacgacagcctgagcagcgaccagagcgagagcgtgagacccagcccccccaagccccacagaagcaagagaggcggcaagaagagacagatgagcgtgagcagcagcgaggaggagggcgtgagcacccccgagtacaccagctgcgaggacgtggagctggagagcgagagcgtgagcgagaagggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagacacctggtgagacactacaagaccctgccccccaagatgcccctgctgcagagcagcagccactggaacatctacagcagcatcctgcccgcccacaccaagaccaagagcgtgaccagacaggacatcagcctgcaccacgagtgcttcaacagcaccgtgctgagattcaccgacgagatcctggtgagcgagctgcagcccttcctggacagagccagaagcgccagcaccaactgcctgagacccgacaccagcctgcacagccccgagagagagagaggcagatggagccccagcctggacagaagaagaccccccagccccagaatccagatccagcacgccagccccgagaacgacagacacagcagaaagagcgagagaagcagcatccagaagcagaccagaaagggcaccgccagcgacgccgagagagtgctgcccacctgcctgagcagaagaggccacgccgcccccagagccaccgaccagcccgtgatcagaggcaagcaccccgccagaagcagaagcagcgagcacagcagcatcagaaccctgtgcagcatgcaccacctggtgcccggcggcagcgccccccccagccccctgctgaccagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96619 - DNA, 1497 bp, Artificial Sequence
  Description of Artificial Sequence: Synthetic coding sequence
atgctgcccagagccaagagaggcagaagcgccgagtgcctgcacaccaccagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggagcaggagaagtacaacagcagcaccaaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96620 - DNA, 3039 bp, Artificial Sequence
  Description of Artificial Sequence: Synthetic coding sequence
atgtgcgcccccggcatccacgtgagcagcgagggctgggaggaggtgagaagcgtggacagcgaggagggcaccatcgaggccagaagagccgtggccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96621 - DNA, 660 bp, Artificial Sequence
  Description of Artificial Sequence: Synthetic coding sequence
atggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96622 - DNA, 2283 bp, Artificial Sequence
  Description of Artificial Sequence: Synthetic coding sequence
atgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96623 - DNA, 2481 bp, Artificial Sequence
  Description of Artificial Sequence: Synthetic coding sequence
atgttcgccggcttcctgcagttcctgctgctgcacaccctgcacagcggcaccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96624 - DNA, 2454 bp, Artificial Sequence
  Description of Artificial Sequence: Synthetic coding sequence
atgtgcgcccccggcatccacgtgagcagcgagggctgggaggaggtgagaagcgtggacagcgaggagggcaccatcgaggccagaagagccgtggccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96625 - DNA, 3567 bp, Artificial Sequence
  Description of Artificial Sequence: Synthetic coding sequence
atgcagttcgagaccctgagacaggtgtgcaacagcgtgctgagccacttccacggcgtgttcagcagcccccccaacatcctgcagaacgagctgttcggccagaccctgaacaacgccagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacagccagaagggcaagagaaagaccagcgagcaggccgtgctgagcgacagcaacaccagaagcgagagacagaaggagatgatgtacttcggcggccacagcctggaggaggacctggagtggagcgagccccagatcaaggacagcggcgtggacacctgcagcagcaccaccctgaacgaggagcacagccacagcgacaagcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96626 - DNA, 4161 bp, Artificial Sequence
  Description of Artificial Sequence: Synthetic coding sequence
atgagcgcccccgtgggccccagaggcagactggcccccatccccgccgccagccagccccccctgcagcccgagatgcccgacctgagccacctgaccgaggaggagagaaagatcatcctggccgtgatggacagacagaagaaggaggtgaaggaggagcacaagccccagctgacccagtggttccccttcagcggcatcaccgagctggtgaacaacgtgctgcagccccagcagaagcagcagaacgagaaggagccccagaccaagctgcaccagcagttcgagatgtacaaggagcaggtgaagaagatgggcgaggagagccagcagcagcaggagcagaagggcgacgcccccacctgcggcatctgccacaagaccaagttcgccgacggctgcggccacaactgcagctactgccagaccaagttctgcgccagatgcggcggcagagtgagcctgagaagcaacaaggtgatgtgggtgtgcaacctgtgcagaaagcagcaggagatcctgaccaagagcggcgcctggttctacaacagcggcagcaacaccccccagcagcccgaccagaaggtgctgagaggcctgagaaacgaggaggccccccaggagaagaagcccaagctgcacgagcagacccagttccagggccccagcggcgacctgagcgtgcccgccgtggagaagagcagaagccacggcctgaccagacagcacagcatcaagaacggcagcggcgtgaagcaccacatcgccagcgacatcgccagcgacagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacatggactacaactggctggaccacaccagctggcacagcagcgaggccagccccatgagcctgcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagccacttcctgaccctgcccagaagcagatacagccagaccatcgaccaccaccacagagacggcagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96627 - DNA, 858 bp, Artificial Sequence
  Description of Artificial Sequence: Synthetic coding sequence
atgggcagacagggcctgggcggcgccagcgccgccggcagaagcatgcagagaagccagagcagaagcagcctgagcgccagcttcgaggccctggccggctacttcccctgcatgaacagcctggaggaggaggagggcgaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96628 - DNA, 384 bp, Artificial Sequence
  Description of Artificial Sequence: Synthetic coding sequence
atgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcctgcccggcctggcctggtggctgaccagagtgatccccgccctgtgggaggccgaggccggcggcagcagaggccaggagatcgagaccatcctggccaacaccgtgaagcccagactgtactag

SEQ ID NO: 96629 - DNA, 4236 bp, Artificial Sequence
  Description of Artificial Sequence: Synthetic coding sequence
atgagcgcccccgtgggccccagaggcagactggcccccatccccgccgccagccagccccccctgcagcccgagatgcccgacctgagccacctgaccgaggaggagagaaagatcatcctggccgtgatggacagacagaagaaggaggtgaaggaggagcacaagccccagctgacccagtggttccccttcagcggcatcaccgagctggtgaacaacgtgctgcagccccagcagaagcagcagaacgagaaggagccccagaccaagctgcaccagcagttcgagatgtacaaggagcaggtgaagaagatgggcgaggagagccagcagcagcaggagcagaagggcgacgcccccacctgcggcatctgccacaagaccaagttcgccgacggctgcggccacaactgcagctactgccagaccaagttctgcgccagatgcggcggcagagtgagcctgagaagcaacaaggtgatgtgggtgtgcaacctgtgcagaaagcagcaggagatcctgaccaagagcggcgcctggttctacaacagcggcagcaacaccccccagcagcccgaccagaaggtgctgagaggcctgagaaacgaggaggccccccaggagaagaagcccaagctgcacgagcagacccagttccagggccccagcggcgacctgagcgtgcccgccgtggagaagagcagaagccacggcctgaccagacagcacagcatcaagaacggcagcggcgtgaagcaccacatcgccagcgacatcgccagcgacagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacagccagaagggcaagagaaagaccagcgagcaggccgtgctgagcgacagcaacaccagaagcgagagacagaaggagatgatgtacttcggcggccacagcctggaggaggacctggagtggagcgagccccagatcaaggacagcggcgtggacacctgcagcagcaccaccctgaacgaggagcacagccacagcgacaagcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag
